United States Patent 12,180,497 (RESISTANCE GENES ASSOCIATED WITH DISEASE RESISTANCE IN SOYBEANS) - sequence listing, part 8

SEQ ID NO: 5 - DNA, 3771400 bp, Glycine tomentella (residues 1-1,885,700 of 3,771,400)
  misc_feature (1552)..(3454): n is a, c, g, or t
  misc_feature (5653)..(7177): n is a, c, g, or t
  misc_feature (14042)..(14531): n is a, c, g, or t
  misc_feature (16332)..(17113): n is a, c, g, or t
  misc_feature (33074)..(33405): n is a, c, g, or t
  misc_feature (38044)..(38594): n is a, c, g, or t
  misc_feature (40206)..(42493): n is a, c, g, or t
  misc_feature (43200)..(44413): n is a, c, g, or t
  misc_feature (51635)..(52051): n is a, c, g, or t
  misc_feature (67934)..(68085): n is a, c, g, or t
  misc_feature (68641)..(69760): n is a, c, g, or t
  misc_feature (74240)..(74530): n is a, c, g, or t
  misc_feature (80406)..(80456): n is a, c, g, or t
  misc_feature (82203)..(84017): n is a, c, g, or t
  misc_feature (84984)..(85167): n is a, c, g, or t
  misc_feature (91340)..(91834): n is a, c, g, or t
  misc_feature (92133)..(92142): n is a, c, g, or t
  misc_feature (92450)..(92528): n is a, c, g, or t
  misc_feature (95257)..(95266): n is a, c, g, or t
  misc_feature (103582)..(104192): n is a, c, g, or t
  misc_feature (106719)..(107424): n is a, c, g, or t
  misc_feature (122202)..(122728): n is a, c, g, or t
  misc_feature (148235)..(148250): n is a, c, g, or t
  misc_feature (163693)..(163762): n is a, c, g, or t
  misc_feature (207647)..(207911): n is a, c, g, or t
  misc_feature (209347)..(209727): n is a, c, g, or t
  misc_feature (212535)..(213537): n is a, c, g, or t
  misc_feature (220477)..(220670): n is a, c, g, or t
  misc_feature (237198)..(237344): n is a, c, g, or t
  misc_feature (263205)..(264433): n is a, c, g, or t
  misc_feature (272347)..(273006): n is a, c, g, or t
  misc_feature (291557)..(292033): n is a, c, g, or t
  misc_feature (308918)..(309077): n is a, c, g, or t
  misc_feature (310812)..(311177): n is a, c, g, or t
  misc_feature (315486)..(315495): n is a, c, g, or t
  misc_feature (319196)..(319597): n is a, c, g, or t
  misc_feature (341077)..(342403): n is a, c, g, or t
  misc_feature (368260)..(369106): n is a, c, g, or t
  misc_feature (371417)..(373819): n is a, c, g, or t
  misc_feature (374674)..(375021): n is a, c, g, or t
  misc_feature (377553)..(378329): n is a, c, g, or t
  misc_feature (389500)..(390095): n is a, c, g, or t
  misc_feature (391944)..(392048): n is a, c, g, or t
  misc_feature (397402)..(398531): n is a, c, g, or t
  misc_feature (407728)..(408061): n is a, c, g, or t
  misc_feature (411173)..(411801): n is a, c, g, or t
  misc_feature (419683)..(421244): n is a, c, g, or t
  misc_feature (425779)..(426508): n is a, c, g, or t
  misc_feature (432041)..(432475): n is a, c, g, or t
  misc_feature (433860)..(434851): n is a, c, g, or t
  misc_feature (441668)..(442812): n is a, c, g, or t
  misc_feature (457026)..(458248): n is a, c, g, or t
  misc_feature (461651)..(463395): n is a, c, g, or t
  misc_feature (465493)..(465647): n is a, c, g, or t
  misc_feature (466943)..(468253): n is a, c, g, or t
  misc_feature (472230)..(472837): n is a, c, g, or t
  misc_feature (487665)..(487949): n is a, c, g, or t
  misc_feature (488468)..(488587): n is a, c, g, or t
  misc_feature (499864)..(500369): n is a, c, g, or t
  misc_feature (509328)..(510577): n is a, c, g, or t
  misc_feature (514796)..(515221): n is a, c, g, or t
  misc_feature (525608)..(526358): n is a, c, g, or t
  misc_feature (547010)..(547760): n is a, c, g, or t
  misc_feature (558919)..(559850): n is a, c, g, or t
  misc_feature (566283)..(567089): n is a, c, g, or t
  misc_feature (569070)..(569079): n is a, c, g, or t
  misc_feature (571674)..(571975): n is a, c, g, or t
  misc_feature (572737)..(575746): n is a, c, g, or t
  misc_feature (576963)..(577586): n is a, c, g, or t
  misc_feature (584528)..(584983): n is a, c, g, or t
  misc_feature (605272)..(605579): n is a, c, g, or t
  misc_feature (609394)..(610165): n is a, c, g, or t
  misc_feature (617896)..(618686): n is a, c, g, or t
  misc_feature (625074)..(626337): n is a, c, g, or t
  misc_feature (627258)..(627267): n is a, c, g, or t
  misc_feature (663437)..(663446): n is a, c, g, or t
  misc_feature (677239)..(678364): n is a, c, g, or t
  misc_feature (691304)..(691622): n is a, c, g, or t
  misc_feature (694593)..(695408): n is a, c, g, or t
  misc_feature (696667)..(699377): n is a, c, g, or t
  misc_feature (700104)..(701196): n is a, c, g, or t
  misc_feature (705689)..(706903): n is a, c, g, or t
  misc_feature (709805)..(710830): n is a, c, g, or t
  misc_feature (711485)..(711664): n is a, c, g, or t
  misc_feature (715293)..(716133): n is a, c, g, or t
  misc_feature (720192)..(720375): n is a, c, g, or t
  misc_feature (727091)..(728152): n is a, c, g, or t
  misc_feature (728581)..(728802): n is a, c, g, or t
  misc_feature (730564)..(731565): n is a, c, g, or t
  misc_feature (732775)..(735305): n is a, c, g, or t
  misc_feature (736276)..(739104): n is a, c, g, or t
  misc_feature (740504)..(740683): n is a, c, g, or t
  misc_feature (745824)..(745833): n is a, c, g, or t
  misc_feature (746627)..(747147): n is a, c, g, or t
  misc_feature (751305)..(751913): n is a, c, g, or t
  misc_feature (756586)..(757020): n is a, c, g, or t
  misc_feature (757601)..(758834): n is a, c, g, or t
  misc_feature (768414)..(770335): n is a, c, g, or t
  misc_feature (771642)..(772619): n is a, c, g, or t
  misc_feature (774210)..(774219): n is a, c, g, or t
  misc_feature (778042)..(782454): n is a, c, g, or t
  misc_feature (789571)..(790087): n is a, c, g, or t
  misc_feature (792649)..(792930): n is a, c, g, or t
  misc_feature (799641)..(800498): n is a, c, g, or t
  misc_feature (808221)..(809554): n is a, c, g, or t
  misc_feature (821576)..(821784): n is a, c, g, or t
  misc_feature (828575)..(829354): n is a, c, g, or t
  misc_feature (839949)..(840264): n is a, c, g, or t
  misc_feature (842111)..(842655): n is a, c, g, or t
  misc_feature (847994)..(848495): n is a, c, g, or t
  misc_feature (853919)..(854241): n is a, c, g, or t
  misc_feature (857078)..(857505): n is a, c, g, or t
  misc_feature (868382)..(869694): n is a, c, g, or t
  misc_feature (880598)..(881115): n is a, c, g, or t
  misc_feature (895058)..(895306): n is a, c, g, or t
  misc_feature (900259)..(900390): n is a, c, g, or t
  misc_feature (902518)..(903087): n is a, c, g, or t
  misc_feature (907240)..(907665): n is a, c, g, or t
  misc_feature (907803)..(908436): n is a, c, g, or t
  misc_feature (911740)..(912234): n is a, c, g, or t
  misc_feature (917770)..(920015): n is a, c, g, or t
  misc_feature (921886)..(924214): n is a, c, g, or t
  misc_feature (935909)..(936079): n is a, c, g, or t
  misc_feature (940572)..(941300): n is a, c, g, or t
  misc_feature (964919)..(965552): n is a, c, g, or t
  misc_feature (968461)..(968470): n is a, c, g, or t
  misc_feature (983074)..(984200): n is a, c, g, or t
  misc_feature (987787)..(987934): n is a, c, g, or t
  misc_feature (988886)..(989540): n is a, c, g, or t
  misc_feature (996469)..(996923): n is a, c, g, or t
  misc_feature (1002811)..(1003416): n is a, c, g, or t
  misc_feature (1013241)..(1013708): n is a, c, g, or t
  misc_feature (1017110)..(1018039): n is a, c, g, or t
  misc_feature (1019869)..(1023158): n is a, c, g, or t
  misc_feature (1024742)..(1026284): n is a, c, g, or t
  misc_feature (1027236)..(1029131): n is a, c, g, or t
  misc_feature (1030180)..(1031934): n is a, c, g, or t
  misc_feature (1042028)..(1042427): n is a, c, g, or t
  misc_feature (1046951)..(1047364): n is a, c, g, or t
  misc_feature (1063230)..(1064182): n is a, c, g, or t
  misc_feature (1080876)..(1081350): n is a, c, g, or t
  misc_feature (1083820)..(1083829): n is a, c, g, or t
  misc_feature (1086180)..(1086431): n is a, c, g, or t
  misc_feature (1093782)..(1094300): n is a, c, g, or t
  misc_feature (1097960)..(1098927): n is a, c, g, or t
  misc_feature (1105724)..(1106919): n is a, c, g, or t
  misc_feature (1115468)..(1115940): n is a, c, g, or t
  misc_feature (1131661)..(1131670): n is a, c, g, or t
  misc_feature (1133112)..(1133889): n is a, c, g, or t
  misc_feature (1136881)..(1138569): n is a, c, g, or t
  misc_feature (1139196)..(1140233): n is a, c, g, or t
  misc_feature (1147636)..(1148052): n is a, c, g, or t
  misc_feature (1155767)..(1155831): n is a, c, g, or t
  misc_feature (1156479)..(1156488): n is a, c, g, or t
  misc_feature (1157626)..(1157853): n is a, c, g, or t
  misc_feature (1163645)..(1163724): n is a, c, g, or t
  misc_feature (1176822)..(1177249): n is a, c, g, or t
  misc_feature (1179638)..(1180437): n is a, c, g, or t
  misc_feature (1182985)..(1183421): n is a, c, g, or t
  misc_feature (1184691)..(1185126): n is a, c, g, or t
  misc_feature (1188184)..(1188439): n is a, c, g, or t
  misc_feature (1198579)..(1200299): n is a, c, g, or t
  misc_feature (1209290)..(1210016): n is a, c, g, or t
  misc_feature (1217134)..(1217372): n is a, c, g, or t
  misc_feature (1219409)..(1220516): n is a, c, g, or t
  misc_feature (1222789)..(1223682): n is a, c, g, or t
  misc_feature (1224108)..(1224332): n is a, c, g, or t
  misc_feature (1226416)..(1227831): n is a, c, g, or t
  misc_feature (1228949)..(1228958): n is a, c, g, or t
  misc_feature (1232011)..(1232964): n is a, c, g, or t
  misc_feature (1239029)..(1239209): n is a, c, g, or t
  misc_feature (1239901)..(1240081): n is a, c, g, or t
  misc_feature (1266517)..(1266647): n is a, c, g, or t
  misc_feature (1274678)..(1275787): n is a, c, g, or t
  misc_feature (1276963)..(1277467): n is a, c, g, or t
  misc_feature (1282764)..(1283026): n is a, c, g, or t
  misc_feature (1286249)..(1286392): n is a, c, g, or t
  misc_feature (1291006)..(1293033): n is a, c, g, or t
  misc_feature (1294636)..(1296850): n is a, c, g, or t
  misc_feature (1340024)..(1341086): n is a, c, g, or t
  misc_feature (1345867)..(1345876): n is a, c, g, or t
  misc_feature (1352172)..(1352699): n is a, c, g, or t
  misc_feature (1367276)..(1367673): n is a, c, g, or t
  misc_feature (1371833)..(1372349): n is a, c, g, or t
  misc_feature (1373554)..(1374036): n is a, c, g, or t
  misc_feature (1376710)..(1377067): n is a, c, g, or t
  misc_feature (1391867)..(1392719): n is a, c, g, or t
  misc_feature (1393976)..(1393985): n is a, c, g, or t
  misc_feature (1414361)..(1414516): n is a, c, g, or t
  misc_feature (1414966)..(1417052): n is a, c, g, or t
  misc_feature (1449044)..(1449297): n is a, c, g, or t
  misc_feature (1460391)..(1461402): n is a, c, g, or t
  misc_feature (1463369)..(1463697): n is a, c, g, or t
  misc_feature (1466381)..(1469323): n is a, c, g, or t
  misc_feature (1470174)..(1472353): n is a, c, g, or t
  misc_feature (1487675)..(1488988): n is a, c, g, or t
  misc_feature (1499336)..(1500876): n is a, c, g, or t
  misc_feature (1503393)..(1504152): n is a, c, g, or t
  misc_feature (1508406)..(1508643): n is a, c, g, or t
  misc_feature (1513395)..(1513810): n is a, c, g, or t
  misc_feature (1543858)..(1544389): n is a, c, g, or t
  misc_feature (1545470)..(1545816): n is a, c, g, or t
  misc_feature (1549517)..(1550463): n is a, c, g, or t
  misc_feature (1552771)..(1552909): n is a, c, g, or t
  misc_feature (1562145)..(1562216): n is a, c, g, or t
  misc_feature (1569535)..(1569674): n is a, c, g, or t
  misc_feature (1572803)..(1572882): n is a, c, g, or t
  misc_feature (1573660)..(1574232): n is a, c, g, or t
  misc_feature (1579414)..(1579604): n is a, c, g, or t
  misc_feature (1585948)..(1586528): n is a, c, g, or t
  misc_feature (1625423)..(1625912): n is a, c, g, or t
  misc_feature (1634103)..(1635046): n is a, c, g, or t
  misc_feature (1646482)..(1646902): n is a, c, g, or t
  misc_feature (1652680)..(1653135): n is a, c, g, or t
  misc_feature (1657133)..(1658011): n is a, c, g, or t
  misc_feature (1663478)..(1664117): n is a, c, g, or t
  misc_feature (1667209)..(1667500): n is a, c, g, or t
  misc_feature (1676409)..(1676890): n is a, c, g, or t
  misc_feature (1677745)..(1677754): n is a, c, g, or t
  misc_feature (1684135)..(1685348): n is a, c, g, or t
  misc_feature (1691563)..(1693991): n is a, c, g, or t
  misc_feature (1697678)..(1698412): n is a, c, g, or t
  misc_feature (1706706)..(1707095): n is a, c, g, or t
  misc_feature (1710494)..(1712169): n is a, c, g, or t
  misc_feature (1723360)..(1724145): n is a, c, g, or t
  misc_feature (1726103)..(1726381): n is a, c, g, or t
  misc_feature (1727526)..(1727704): n is a, c, g, or t
  misc_feature (1734141)..(1734781): n is a, c, g, or t
  misc_feature (1735588)..(1736135): n is a, c, g, or t
  misc_feature (1738742)..(1739914): n is a, c, g, or t
  misc_feature (1740504)..(1740720): n is a, c, g, or t
  misc_feature (1742500)..(1743309): n is a, c, g, or t
  misc_feature (1754575)..(1754888): n is a, c, g, or t
  misc_feature (1768741)..(1769506): n is a, c, g, or t
  misc_feature (1771264)..(1771273): n is a, c, g, or t
  misc_feature (1772411)..(1774093): n is a, c, g, or t
  misc_feature (1787517)..(1787970): n is a, c, g, or t
  misc_feature (1814043)..(1814055): n is a, c, g, or t
  misc_feature (1819132)..(1819778): n is a, c, g, or t
  misc_feature (1828359)..(1829360): n is a, c, g, or t
  misc_feature (1832992)..(1833553): n is a, c, g, or t
  misc_feature (1849342)..(1849867): n is a, c, g, or t
  misc_feature (1853584)..(1854274): n is a, c, g, or t
  misc_feature (1855729)..(1856447): n is a, c, g, or t
  misc_feature (1862844)..(1863061): n is a, c, g, or t
  misc_feature (1872183)..(1872337): n is a, c, g, or t
  misc_feature (1880017)..(1880526): n is a, c, g, or t
  misc_feature (1882083)..(1882092): n is a, c, g, or t
  misc_feature (1883604)..(1883874): n is a, c, g, or t
  misc_feature (1900385)..(1901610): n is a, c, g, or t
  misc_feature (1913375)..(1913424): n is a, c, g, or t
  misc_feature (1919702)..(1920180): n is a, c, g, or t
  misc_feature (1927448)..(1927824): n is a, c, g, or t
  misc_feature (1935739)..(1935865): n is a, c, g, or t
  misc_feature (1939886)..(1940005): n is a, c, g, or t
  misc_feature (1945223)..(1945306): n is a, c, g, or t
  misc_feature (1949239)..(1949380): n is a, c, g, or t
  misc_feature (1951086)..(1952331): n is a, c, g, or t
  misc_feature (1959556)..(1959767): n is a, c, g, or t
  misc_feature (1966186)..(1967076): n is a, c, g, or t
  misc_feature (1969444)..(1969453): n is a, c, g, or t
  misc_feature (1972147)..(1973800): n is a, c, g, or t
  misc_feature (1977712)..(1977990): n is a, c, g, or t
  misc_feature (1986366)..(1986926): n is a, c, g, or t
  misc_feature (1989195)..(1989819): n is a, c, g, or t
  misc_feature (1992213)..(1993822): n is a, c, g, or t
  misc_feature (1999731)..(2001678): n is a, c, g, or t
  misc_feature (2025860)..(2026509): n is a, c, g, or t
  misc_feature (2032735)..(2033774): n is a, c, g, or t
  misc_feature (2036117)..(2036452): n is a, c, g, or t
  misc_feature (2039533)..(2041503): n is a, c, g, or t
  misc_feature (2043074)..(2043586): n is a, c, g, or t
  misc_feature (2044687)..(2045042): n is a, c, g, or t
  misc_feature (2045925)..(2046367): n is a, c, g, or t
  misc_feature (2048901)..(2049614): n is a, c, g, or t
  misc_feature (2053761)..(2054237): n is a, c, g, or t
  misc_feature (2055053)..(2055465): n is a, c, g, or t
  misc_feature (2058761)..(2060837): n is a, c, g, or t
  misc_feature (2073049)..(2073410): n is a, c, g, or t
  misc_feature (2074755)..(2074817): n is a, c, g, or t
  misc_feature (2076668)..(2077648): n is a, c, g, or t
  misc_feature (2078104)..(2079057): n is a, c, g, or t
  misc_feature (2080934)..(2082369): n is a, c, g, or t
  misc_feature (2090301)..(2090970): n is a, c, g, or t
  misc_feature (2096234)..(2096801): n is a, c, g, or t
  misc_feature (2099631)..(2099787): n is a, c, g, or t
  misc_feature (2104744)..(2105927): n is a, c, g, or t
  misc_feature (2107503)..(2107737): n is a, c, g, or t
  misc_feature (2110074)..(2110548): n is a, c, g, or t
  misc_feature (2116376)..(2116851): n is a, c, g, or t
  misc_feature (2122727)..(2123200): n is a, c, g, or t
  misc_feature (2129083)..(2130212): n is a, c, g, or t
  misc_feature (2135588)..(2136039): n is a, c, g, or t
  misc_feature (2137401)..(2139656): n is a, c, g, or t
  misc_feature (2152878)..(2153599): n is a, c, g, or t
  misc_feature (2155897)..(2156812): n is a, c, g, or t
  misc_feature (2162239)..(2162394): n is a, c, g, or t
  misc_feature (2170226)..(2170235): n is a, c, g, or t
  misc_feature (2183827)..(2184016): n is a, c, g, or t
  misc_feature (2192039)..(2192713): n is a, c, g, or t
  misc_feature (2195551)..(2195706): n is a, c, g, or t
  misc_feature (2200205)..(2200501): n is a, c, g, or t
  misc_feature (2204112)..(2204121): n is a, c, g, or t
  misc_feature (2207771)..(2207780): n is a, c, g, or t
  misc_feature (2208711)..(2208991): n is a, c, g, or t
  misc_feature (2215532)..(2216729): n is a, c, g, or t
  misc_feature (2221370)..(2222103): n is a, c, g, or t
  misc_feature (2227574)..(2228255): n is a, c, g, or t
  misc_feature (2235787)..(2236653): n is a, c, g, or t
  misc_feature (2237005)..(2237375): n is a, c, g, or t
  misc_feature (2238525)..(2240991): n is a, c, g, or t
  misc_feature (2242217)..(2242320): n is a, c, g, or t
  misc_feature (2243184)..(2245275): n is a, c, g, or t
  misc_feature (2251968)..(2252963): n is a, c, g, or t
  misc_feature (2263612)..(2265687): n is a, c, g, or t
  misc_feature (2266385)..(2267404): n is a, c, g, or t
  misc_feature (2271251)..(2272239): n is a, c, g, or t
  misc_feature (2273905)..(2274980): n is a, c, g, or t
  misc_feature (2287925)..(2288412): n is a, c, g, or t
  misc_feature (2288991)..(2289130): n is a, c, g, or t
  misc_feature (2290990)..(2291540): n is a, c, g, or t
  misc_feature (2298060)..(2298953): n is a, c, g, or t
  misc_feature (2305635)..(2305855): n is a, c, g, or t
  misc_feature (2311127)..(2312575): n is a, c, g, or t
  misc_feature (2321414)..(2322012): n is a, c, g, or t
  misc_feature (2323689)..(2323859): n is a, c, g, or t
  misc_feature (2334806)..(2335819): n is a, c, g, or t
  misc_feature (2336155)..(2336164): n is a, c, g, or t
  misc_feature (2336679)..(2336993): n is a, c, g, or t
  misc_feature (2339664)..(2340486): n is a, c, g, or t
  misc_feature (2347375)..(2348331): n is a, c, g, or t
  misc_feature (2355560)..(2356062): n is a, c, g, or t
  misc_feature (2360254)..(2361041): n is a, c, g, or t
  misc_feature (2364431)..(2366228): n is a, c, g, or t
  misc_feature (2379211)..(2379885): n is a, c, g, or t
  misc_feature (2380592)..(2381115): n is a, c, g, or t
  misc_feature (2388152)..(2388637): n is a, c, g, or t
  misc_feature (2393315)..(2393888): n is a, c, g, or t
  misc_feature (2398326)..(2399032): n is a, c, g, or t
  misc_feature (2411913)..(2412430): n is a, c, g, or t
  misc_feature (2416220)..(2416618): n is a, c, g, or t
  misc_feature (2419487)..(2420436): n is a, c, g, or t
  misc_feature (2425229)..(2425240): n is a, c, g, or t
  misc_feature (2435865)..(2435874): n is a, c, g, or t
  misc_feature (2446097)..(2446609): n is a, c, g, or t
  misc_feature (2468425)..(2469018): n is a, c, g, or t
  misc_feature (2469970)..(2469979): n is a, c, g, or t
  misc_feature (2475805)..(2476281): n is a, c, g, or t
  misc_feature (2490536)..(2490759): n is a, c, g, or t
  misc_feature (2494165)..(2494937): n is a, c, g, or t
  misc_feature (2496347)..(2496955): n is a, c, g, or t
  misc_feature (2508131)..(2508347): n is a, c, g, or t
  misc_feature (2510834)..(2510843): n is a, c, g, or t
  misc_feature (2518846)..(2519237): n is a, c, g, or t
  misc_feature (2524522)..(2525074): n is a, c, g, or t
  misc_feature (2544115)..(2544758): n is a, c, g, or t
  misc_feature (2551729)..(2552371): n is a, c, g, or t
  misc_feature (2554938)..(2555751): n is a, c, g, or t
  misc_feature (2563269)..(2563511): n is a, c, g, or t
  misc_feature (2576782)..(2577129): n is a, c, g, or t
  misc_feature (2580032)..(2580469): n is a, c, g, or t
  misc_feature (2598566)..(2599386): n is a, c, g, or t
  misc_feature (2601993)..(2602316): n is a, c, g, or t
  misc_feature (2612592)..(2613945): n is a, c, g, or t
  misc_feature (2617277)..(2617840): n is a, c, g, or t
  misc_feature (2634290)..(2634539): n is a, c, g, or t
  misc_feature (2640950)..(2641015): n is a, c, g, or t
  misc_feature (2643462)..(2643807): n is a, c, g, or t
  misc_feature (2653580)..(2655011): n is a, c, g, or t
  misc_feature (2664306)..(2665182): n is a, c, g, or t
  misc_feature (2665718)..(2666244): n is a, c, g, or t
  misc_feature (2668695)..(2669251): n is a, c, g, or t
  misc_feature (2680675)..(2680842): n is a, c, g, or t
  misc_feature (2684186)..(2684781): n is a, c, g, or t
  misc_feature (2696402)..(2696739): n is a, c, g, or t
  misc_feature (2704098)..(2704320): n is a, c, g, or t
  misc_feature (2706517)..(2706875): n is a, c, g, or t
  misc_feature (2710251)..(2710576): n is a, c, g, or t
  misc_feature (2712326)..(2712335): n is a, c, g, or t
  misc_feature (2713094)..(2713215): n is a, c, g, or t
  misc_feature (2741299)..(2741496): n is a, c, g, or t
  misc_feature (2744837)..(2745641): n is a, c, g, or t
  misc_feature (2756171)..(2756751): n is a, c, g, or t
  misc_feature (2756889)..(2757517): n is a, c, g, or t
  misc_feature (2782403)..(2782568): n is a, c, g, or t
  misc_feature (2792221)..(2792382): n is a, c, g, or t
  misc_feature (2796608)..(2798266): n is a, c, g, or t
  misc_feature (2804317)..(2805181): n is a, c, g, or t
  misc_feature (2812497)..(2813548): n is a, c, g, or t
  misc_feature (2816250)..(2816294): n is a, c, g, or t
  misc_feature (2843364)..(2844769): n is a, c, g, or t
  misc_feature (2845719)..(2846347): n is a, c, g, or t
  misc_feature (2868809)..(2869501): n is a, c, g, or t
  misc_feature (2874410)..(2874655): n is a, c, g, or t
  misc_feature (2875373)..(2875421): n is a, c, g, or t
  misc_feature (2877536)..(2878017): n is a, c, g, or t
  misc_feature (2898613)..(2899327): n is a, c, g, or t
  misc_feature (2901303)..(2901873): n is a, c, g, or t
  misc_feature (2910413)..(2910998): n is a, c, g, or t
  misc_feature (2913423)..(2916158): n is a, c, g, or t
  misc_feature (2921199)..(2921934): n is a, c, g, or t
  misc_feature (2923537)..(2927958): n is a, c, g, or t
  misc_feature (2928306)..(2928725): n is a, c, g, or t
  misc_feature (2937378)..(2938098): n is a, c, g, or t
  misc_feature (2956640)..(2956770): n is a, c, g, or t
  misc_feature (2958244)..(2958513): n is a, c, g, or t
  misc_feature (2961010)..(2962355): n is a, c, g, or t
  misc_feature (2974263)..(2974272): n is a, c, g, or t
  misc_feature (2974846)..(2974855): n is a, c, g, or t
  misc_feature (2983474)..(2983984): n is a, c, g, or t
  misc_feature (2984775)..(2985933): n is a, c, g, or t
  misc_feature (2989736)..(2989969): n is a, c, g, or t
  misc_feature (2994539)..(2994626): n is a, c, g, or t
  misc_feature (2999010)..(2999019): n is a, c, g, or t
  misc_feature (3006041)..(3006536): n is a, c, g, or t
  misc_feature (3019416)..(3019791): n is a, c, g, or t
  misc_feature (3024020)..(3026007): n is a, c, g, or t
  misc_feature (3028831)..(3031062): n is a, c, g, or t
  misc_feature (3031922)..(3033332): n is a, c, g, or t
  misc_feature (3033823)..(3034028): n is a, c, g, or t
  misc_feature (3035765)..(3036765): n is a, c, g, or t
  misc_feature (3041566)..(3041922): n is a, c, g, or t
  misc_feature (3047445)..(3047517): n is a, c, g, or t
  misc_feature (3048238)..(3048916): n is a, c, g, or t
  misc_feature (3063843)..(3065144): n is a, c, g, or t
  misc_feature (3070717)..(3071144): n is a, c, g, or t
  misc_feature (3072653)..(3072662): n is a, c, g, or t
  misc_feature (3113133)..(3113239): n is a, c, g, or t
  misc_feature (3130455)..(3131536): n is a, c, g, or t
  misc_feature (3185977)..(3186406): n is a, c, g, or t
  misc_feature (3188364)..(3190095): n is a, c, g, or t
  misc_feature (3192980)..(3193724): n is a, c, g, or t
  misc_feature (3210713)..(3211565): n is a, c, g, or t
  misc_feature (3229591)..(3230487): n is a, c, g, or t
  misc_feature (3381223)..(3383659): n is a, c, g, or t
  misc_feature (3406220)..(3406897): n is a, c, g, or t
  misc_feature (3410160)..(3410169): n is a, c, g, or t
  misc_feature (3421256)..(3421265): n is a, c, g, or t
  misc_feature (3422437)..(3423908): n is a, c, g, or t
  misc_feature (3477431)..(3477478): n is a, c, g, or t
  misc_feature (3510511)..(3510713): n is a, c, g, or t
  misc_feature (3511004)..(3511164): n is a, c, g, or t
  misc_feature (3534517)..(3536057): n is a, c, g, or t
  misc_feature (3562147)..(3562197): n is a, c, g, or t
  misc_feature (3585108)..(3586248): n is a, c, g, or t
  misc_feature (3630839)..(3632104): n is a, c, g, or t
  misc_feature (3657066)..(3657744): n is a, c, g, or t
  misc_feature (3660075)..(3660890): n is a, c, g, or t
  misc_feature (3664708)..(3665308): n is a, c, g, or t
  misc_feature (3666216)..(3667376): n is a, c, g, or t
  misc_feature (3710638)..(3711758): n is a, c, g, or t
  misc_feature (3746990)..(3747572): n is a, c, g, or t
aagatgaaacaaacaggaaaattaacagcacacccctgtgaaatcaccaattttggagactagatttgtgattgtgagaaaaccatcgatgcacaaaaacaaaattgaaggtcctcagttaaaaaaaaacatcatgaatcaccacaaaattttccagcactggagagactcaacaacctttgccagacagaagtaatttattcagcaacaaaacaaattggttggggaaaagagggaattcaggaacttaggatccacccaccaaaaggaaaacaactcacttcaaatctcagggaccccgcaagacaaatggaaattccggtcagttgtttattttttgtgccctcaattgaaaacaaaaaattccagaaattcactttgaaaaaagaatgaaaagacagaataaagagaaaggaaactttacaataattctggaaggatgaacagaaaagcagttgaggtaaccaatatatggcccaaaggggtgctgataatgaaataacaaagcaaaggcagatcaagtcttcaaatttcaagtaccacacaagctgcacaaggcagcatgttatatatacaacaccttgagactcatatgagaagaggatagacatgaagatgaaaaaaaaaaaatcaaaaacaaaaaacgtgaaaagtgaagagagagaaagagaaggagagagagagagagagaagaaatacttcaatgcaatctaccgagataagaataaactgaaattctgcagtggaaccaagcaaggttggcttgataattgagcagcttgatgaacagtgtcttggcttttgattatggccaaagggcaagagatttttgagacaattaccaaccaatgctatgcaatcagacagaactcatgagagagtttcttattttctcattttctgctttttatgctgggaacaacaacttgaaacatctactcatcaatacttatctgttttcatggaatgtatgtctaatagtataataataataataaaatatgtgtggaaaagagagagagagagagagagagagagaatatttctggggttgatgggtctgaaccataaaatgacccatgcatttgttgtggtcacaaatcacagtgccacttgttttggcacatttcaatttgcagaaacaataatgatggattgaacagccacgtttgttttggtataatgtttcaatgtcatcactaaatctgatattttagtactattaccctagttttagtttgtttgttaagggcacggtaagagtggtaagggcactgatgttaaggaattaaaaaataattatattaaaatgagtaatattatatttttaggatttttttattttcttatatttttatattcaatattcttttaatgtcttaattagtgtttaaaagtaatttttagtaagactctttttttaacgtctttggttacatttatgaggaatttaatgattttattagagagagataataactgttgaaaatttaatgattttattagagagagataataactgttgaaaataagaatatgacagagttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttacttttcatttttttttttgtttcaaaacagttttcatttacttatcaatcagtttctcatttaaaaatctactgagttttaaaaactattatgaaaaagtgttttaaaaactataaaacagaaacaagttaaagaaattttccttttcagttctcaataataacaaatgggttaagatatcagctggttaaaatagcaagcacactatgttctcaaggagaaaaaaataagataaaagtatatagaaagaaagaaaaatgtcattggcaggaaggttggttcacgggaaggcataggtaagctggaggccacaattgaaaatcaatagctgttttcattataccttaactaaaaaacttaattcaccaaccaaacaacttttttctattttctagtttttgaaaactaatgacagtttttaaaaatgatattcaaacacaccataaatttcttcttttttcttatttgattgcataaaaaatagaaggaaagaaaatatatactatatactctggaataaatatatattcttaataaaaaaagtgtgtaaatataatagtttggtattataatcatacaaaaatgatttttttcctcctttctcttcaaaaatggaaagatcaaaacagtgatgggccacatttatatactttcttaaatagagatataaaatgggtcaaatgattaagaaaaaaggaaaaaaaaaaagaaaaaaaaattcatattcaatctcttcaagtaacaaaaactaatcattaatatttgttgataaaaaaatatttatatactttcttacgttttttttttcttttgacatttgtcccaaacaaatgaataaatgttttatgctaattaaccataagtaagtgtgttaaactatgattcccttaaccaagtcatagccatgcatggttctctcttaatttcttgctcagccatttttccctgcttcccttcccccacaactcattcaatagcttgtcccattcgtgtggtaaaggtttgttggaaaaccaaaattagatcgaagttcatccaaaaaccaaaattctattgcgcctgtcactgcatgcgtttaacactttaactttaatgggggtggggtcatttcgtggtaacttgagtcagttttaatttgtttctttctttccatgggttgacacaccaataagtagaagaagggaaattggaatcttcctcctttgaagaacaaggaattagctctttattctgccatagttcttcgtttggcaacttaaagtatatctaaaatttctcttacttctaagatcatcttgatttttcattttattttacagacagtttaaattaggggaagacttattcctttgtaaagtcactaaatatcattaacctcaacaataatttaatatcatgtgaataaaaagaaaatataagaatataacccaaatcataactagtgtaagcagaaattaaactcaaccagacatgttatactggatatatagatgttcagttactctagtccaacacctgtccggctctctataaggctaaaatgaccttaattagaggcagcaagaggttagaccctttaataatgcttagaggtaaactaaatggtaatttgttctttaaggcccaagaaggttttatttaattacggtattggtacaaactacagagtatttattatttttatgggtgaataatttttgttagcaaatttgactagtcatttttagtgagatttttttttaaattagattttttttatctaaaaactcaaattcaagacttaatttaagaaaagatcaaatctaatatcactcaaattaataacttattgataaaactaaaaaaggtttgtatatttataaagttaagatcctacatatgaagatcactacacaattcgcatttactatccggtatataccgaacactggaataagagacgaataaaaacaaggagtacgactaagggctaaggaccatagtgccccccagccactgtttggcagcaacatatatgtctgttaaaaaaaaaaatagaagataaattacaaataaattaaccaaaacaagcacatgaaaagaatagcaagtatgcaagatctgccatcaatataaataaaatatagacaattaagttcaagatctaacatatatcttaaaattagaaaaaagttacataaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaagttaatcctttgtatctacaaaaatgttattatatcaaataaaaatataaatacatgattaaagtgggttcaaatattacaacccctaatcaatcaattaatagtttagatttgacttttctaaaattatgaaagttaaaatatgtaatttcagtcgttgataagaaaattaatagtgaatattataatatatttatgatttattatatatacacattaaatcaataattattttttattcaacaaataaaattacttctttcaatttagaaaagccgaatcctaatggtttagagccatcagcaatacaatttggcagccaggctccaatagaagttagaacttggaaccagtaaaagaaaagtttgtttacgtctctagaaattcaaaattttctattcgtgtgggagaataattgttttctttttaaaggcaaatttattaaaagatttaacccacaaggtgtgttccaaaaccttatcagaggatacactgttggtaatcgacaatcacacacaaatcaaaaaacagaaaagaaaatagggaagagagatatgacacagtactttatcctgattcacccaatgtaggctacgtccagcttgtctatactataatcaccttaccgccactcgttacaagtcacacggtttacaagtggaatataaataggattaaaaagaaaccctaacagcagctattcatggaccctagcccaaactactaataaaagtaaaatattacaaataatcagaggcccataacagtacctagtctctgcgggcctgggggcgctgccccccggacccccgtccgctcacctgggagcgggaccccagttggctttctgctgaccccgccaacaagaagggttgtcatctgactgcgaaagatgagccatatccaacatacacatcatgtttacatatagtaacctcaaaaaatcctcacaaaaacttctcaaaatgagaagcatggaaaataaaagctcaagaacaactaataaacaaaacaacacgatatgcttattcgagaggaatgattaagctaatataactctcagtctattttgtctaaaaagaaatctcagtcaattaattcatatgctcaataataaggcataaattaaattatatcatcacagataaaattttgatcttaaggtaaatgagtttttgaaagtaaagggcaatatcaacttttttgatacgtattattagattcgatttgaaatattaattctgaatttaaattatacttcagttcttgaaagttctattctcaaatcaaatactttaaagtttctctcttctccaattgcttaggaactaggaaggttctatggctgttagcgtggctaattagcacacttattattaaaatgaaatgcatctttcaagtgattattatcattatttttctttcctcgttaagtcacgtgttatttttttaataaataatgatatgtcttcttacaaatttcttattattttataaaaattattaaataaaagtaaatatttttaaatgtaaaatacagtcaatatttgttataaatataaaaattaaaaaccgagctaaaagaatttaaaattacttttttaaatttattgtagcttgttgaaaaattggtgattgaaacctaacttgcacttctcacaccgttccccactaacactcattaacttattgacctcttcagtgactgagatttgtatatatattttttgttaatgactgagacttgtatggacgaacgacactgctatattgctagcactaatatattaaataggagtctcctgcattattgttgttttgcaaattcataatattattgatattggggaaatgaggacatatttacaatctaatgaattggtatctttttataaagccgtgacactatttttttttattaattttaaataatgggcattagagaattctttaagaacacgtaacattattggtttgtcttaatcaaaatacatccactaatttttcattaattgaatgagttcatctatatagtaacagttattttttttggacagattagtaacagttattaatatttttttataaagttattactatattgtgcattataagattaccttttttaaatattattacgattaggaagtttttcaaaaattgctttttccgcccttaataatttttcatttacaattgctagttgttttggattacggttaaggttcaatttacataatgatctactttggtctacgttggattaattcaaattgtaagagtcgaagttaacatcaagtataggccttctaatatacattcgcgaatcataaattacacattagtttgaagcaaagttataatttgctatgccaagaaagagtattattgctcacatgaggccttgggttttgtgccgtagaatatagacaatctcaaattcttataaataaaccaacgtcattatgactcataagtatttattattttattacatagagttactctggtataatattcaataacttaattaagttttaaagtatttttacaagtaattattcacttacacaatgtcttaattaactatattttagagcttaattaccaccaactaaagctcttgaacttcagtctacgtagaagtcaacctcagtcaacactcaccaaagttcagagtcatagttagtcgtccatcttgaacacgttagtacaatccatcttagagtataattggtgacttggtgtcgtctgtgaattttttttatatatatcataattaacagaagcaagatgataaaacaactcaatttgagctcacttcagatggacatactaaagatgtaagttttcaggttccacttgtttatacaacaactacaaaaatagattgtcaaatattgaagcaacatccaaaaccagtttaaccacctattaacgagtttcaactataactaagtcctatatcatcaaaatcaactatgtagtgcatctacatacatttgatttatagctgaaattgttggtgcatgttttaacaaaattcaatggataaaaataaatataaataaaacaatttttttaaaaatatttttgtctcaaaaaacacttttcatcgaattttcaaacatgctcataattgaataaatagcatgtaaaatgaatgtttacatgctatttatagagtttgttagtagtaataataacaatcagcacaaattaactaactaaccaatttcaacgaaaataaatattttttcctaattataaaatccctttaattaattcatgtcttttaaaaaaataataattattttcttatctttctattcacttaattatttatcattaattctggagagaaaaataattaagaatatgtaaagaataattaatatatctaaaaattgaaaaaaaaatctataaataaataaataattttttaaaaagattttataataaaaaaaatccactaaccgtacgaaaaaaaaaacattatacagtaaatctcgtgaggctagttcgctatactgcaacaacgaagtacaaatcctaataaatgcaataatatcgaacaatcatctaatgactgcatctaacagccaatctattttacacgatgtccactaaaattggctctcacacgacagctgcactaattgttgggtcccagacacgtgagtgaaaataatggccatgttcctatcaactccttaccaaaaattcagaaaaagagcaaagcctaaacagtgtaccagggtttacaaaattgttcagattgcttattatagaacaacttcatgtcttacaaaaaatatcaaaaccggcctcttagatttagggtttaattaaatagtgtcttacgtacatataagatataacacatcgttattatcatgtaaagataatatatgaacaaagtaattttagcataaatttcactgtttccggaattttagattatgtttcaaaagaatatgtaagatccatgcattgatagagactatcctcttctagatatatcatgcatatatgcagacctacacaaatagatcagatctaacaaactcttcgtacacctagagccagcataatgttgttgcagtttgggtgtaaataattaaagtggaagaaaagaagaagaagaaaaaaaaaactaaatttaagggaagagatacaaaggaggaaagttattttgatatacgaacatttatgctaacaaaaattggaggacaagttaaaattcattttaaatttgtgagaatttttcaattagaatatttatttgtctcccattgatggtttatgtggttacgttggggacgtggtttgaagatgtcttttatatataaaaatgagaacttaattgtagaaaagttatatgtgcaatttattttaaagaaattgaaatagatgtacggtttttcattggaccactgaactgcttctcgatctggagttgttttccgtgcaactttgggaccgttcgtttggcttgtctaattaatcaaagatgtgcatgaataacattaaaaaacaatatacgtacattttcgtcaaccatgatctgtttcggcatatagggaatttcattttgaattgtgcttggcttttatattactaagagaggttaattggtaagcaatttgatatacttgttctcacatgcaagaaattaagaaccgaagaatattccatattcccctcggggggaaaaaacaaaaggaactgggcttgtggtataagggtagaattctgttttcaaatttgttctggtatgcacctcaagagattatttggtgtgacatggttaggagtttatttctggttttgtgcatatgaacaaatatatattaaaagatgttacttttttaaatgaattttagtattttgaagaatttttcattgattctcagtagagaaatacaatggccaacaaaaaaaaaataatgatgtgttacttttttattagtttaaataatgttgtgtcacatcatttttagcaaataaaaaaaataaattaattcctttgaaaatgaaaatgtggagtagagaaatgatgtcatagatatttaaagacaaaataatagtaaagttagttttataaatttgttatacattttttatttttaaaaatttatgtaaaataaaaataggacaacacttaatattggacgagttacataattaatattatttattgatgtggtcgaggtggtgcaagatgcatcaattattcttcattgaattttacgggaaagttcccatattaatatgcattcaatttcccgtatgtgaggaaattaatatttttttagtagtatgaattgaagacgttatgagaaaatttataataactcatatattttatttaaccaaatgagccgagctaaactatgggataaaggaaaatgttaaacgtgccttaaaatttttatagcacaagttttattgatttcacaatatttgtgaacatttgagtttctgctgctccccaaacgagtgcccatacaaaaagtgtggacaacatgatgctattgggtttggatgtatgtatgatggttgcggaatgtttctttcacaccctttttcagttttctacacttcttttacattccattactcttttgcattttaattcatttacacgctgaagcagagtgtgaattccaaaaagtgagagattttatgctctattttggatgtaatcattttcgaaaatctatgctctataataggttgtggacatatgagtggaatgtgggccttgccgtgtagtgttgtgttctgggccttttgttctttgaagtgctctgagtctgactgtcaacttattagatatcatcctaaatatgatttttaaaataattattatataagtcaataaaattatcatgagatatgattagataatatgtagtatttttttatattttcaatatattttaattcaattcaatttttattgagaattaggataaagttacgataaaaatcagagtgtgtattgggaagtaataacatgttttcactaaaaattatatattttcaattcttttagtattatcctgaaagtacttgttagcattcttagtaataagctaaaatgtgaacttcaaaatcagcgagccaatctcattgataatgagattaatttactttatcaattcactggaattggtatttttttaggtacatacatattctcaggagacggatctagaaaaataattaaaggagatactagtggccgtcatacacttagtagtagggattcgggggcaacactcccttatttttttataaaaaaatttaaaagaataaataattataaatcataatctaaaagaacaaataatgaattttttaacattcacataagatataagagaacatagaaatatatatatatattatatatataaagttataaatataaatttgaagaatatatctagtatcagatattaagaatgctaattttacaagtaaaataaaatcttatttttattgatgtataaattgaatgacgacttacaaaaacaatactatctacgtcattataatctttgtttactgaacgaacatgttatcctcgtagatcaattttatttcatttggtaatgtaaaacctgtcccatttcagtgtcaaattatgccataagattacacacctttttgacaattggatcattggttgatgaagtcgaaaaatgttaaacgtaaatagagatagagaaaataatagatattttaagttatatgataaacaaatagaaattagataaaaaaattcaaattcatatatttataataatccaatgaagccaccctcgacgtcactttagctattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattttggacatgtaattacattaaataattaaagaaagaatagttaaagtcagcacaagtaaaatgtacgtaacattctcttaatttgtctcaaaataatttaaattttggacatgtaatcacattattaaaaaaatttggacaccgaatacactattttcttgtatacataaatgcttagtcatttcacgttcattttccatttgtagatgggaagggactagttcaattcaacattgcaaataagaatgcccatgctacttttttgatgatgaattcttaaacgagagactaacaatgggttgagagtactagagcttcttctaagacggtttagagatgaagtcaaagtatgacacgttcttcattaattattcatcctcttgaaaattaagcactgtttataccaaattcaaattttttcaccctctatacatggtgtctaccatccacataacaatgtaacatgctttctttttcatggcttgatgctgtctccggaaacacttttcttgttttaaaccttttctacaaggtgttgttaactaatgtctttataacattgagtaaagaattaaaaaattatattgtgaaaattataaaaaatatataaaaaaagttataaatattttttttccttaactaataccttaagaatattgattgaaatttttctttctacaaaaactaatggatttaattaagggttttattaaccaatacctttagagtattagttaaagaagttaaaaaagaaaatatgtattatataaatcataaaaaatctatgaataacataatttgtcatcttttaataaaatattttcttttaaatatcttaaccaatatttttaggatactggttagtgtttttgtttaattaattactttcaaacatagctatcgtcacattccttgcttgactctatgcggacactattcccacaagagaatatgctgtccccaaacaaagaaccaaatatttgtgagacattctccatggttcacaaggcagcgtgggaaaaacttggcattttcgtaggaaaggtactaatgctagttggagagggttcataaagcatggtgaattaataaattgtgtaatcaagtttttttttagtgatatccacctaaaatttacttcttctacactcatatataagaaaaagataataaaatttacacaaattaagaaagttggttgacattatttaattttattaatcttaaataaaaaataattatttctaaaatgtttttcattgaaatttattatcatgaataaaaataaatcattgaaaataaaattagaattaaataaaaagtattttaagaatgataatattaaataggataaaattagttagatttatttatattgatgttaaacagataaattttttttcttctcatgtatgagaccaaagagaataatatttaatacatatagttacgtcaaagaatatggtttaggtacttttttttccattatttatcttaaaagttaaaagagagacatgtgcaatttcaaagaggttagatgaaacttcttacaatttgattatacgtacgaattctttcttaatggaatcaacaactgatagaaagttctcgtcacccaaatgttactttgaatatgcatgcaatcttgaatttttccaaacttcatgttcattccttgttgttggactaaaaaggtttaatttggatatgcaactaaagatggtttaatggcactttgaatcccgattcatttgaaaataataaaaaaaaaaaaaacgagggacatatgtctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatcattttctttttattttgatgatttgtattatgttgtgaaacttgttataataaatatgccttcaagacaaatttaagatacagtgtcgttgatatgacaacaaattaaacctttgaaattttcaatactaataataacaataatagtgccttggcgtgtcaggttgttgggaagttggctattaaatataaagcctaacaatatattttgtgatgttctttttaattattattatttttatgtggaaactagtaaaaatttattagagactaaccataaaaaaaggaattatacttacacaatttcgtcattgcaaaaatgtgtgtctatattggagtatgttgttagaaaaaattataccattgctgtcaaatgaaatattaccatttacaagttgacattctttttccaactttcaacgtcacgttggcaattcacgcattaaggaagttgtcgtgtgcatgaacataagagtcaaaatcttaccaatacttaataaaagcaggtaggattttagattttagagcctggtttggggcgcttggcccttacttcaatctttgaagagtcaacgtgaacaaaacagttatgtttacattggttcaatgaataacaattgactacgctatttcctcagttaccccttgcttcacttctttatccaaaggccatacacttggcattttcttcttacttcttcccagacaaacaaatacttacaattttggagaaatttttcatttcattcacacccttttcaccattggtgctgttttggcctgagaaagaaaaataaaaaactttcatcatgggaaactcctgcagaaaaccagtggctcatgtgtcttcagcaagtttctttggtcagttttaatttggttactttaaccatatctatatgactatataactttttctaatttatcttttttagtacaaagtataaagccttcaattgtttttcttcaacttttctgttatcatcagttagcacttgtcatgccacttaggttgatgatgatgatgccttaaatatgattacggtttgttatattggatgattttatttttctctctttggtatccacggagagaagaagaaggcgatgttctcaaaatggtaaaggttaaaacaatagttcataggttgtaacgtgaaagattataggactagctagtcttgaattgagcttcttttgttttcttgtttgtttattgttctcaagtccttggcttcctaggattgaattgaatttttgtcttttgagtaatttatatataaaccttctgtattgtgttaatattggcctgaaaaaaatggagattatgaggcttcgtcgctctgaatcaggttctaaataatgttgaataatttttgcttttttctgttaatgcagttgctagtgtgtggattgaaattagctgcattttcctttggctattttttctttcttttcaacaataaggcactggtgctccgaatgagctaattgtatgttactggatgtttgtataacatctccctccccctttgcttgtttaaaacaattcttgtctatcgagaataatgtaaaaggggttagttcaatgatgaaatgcgttcagcaaaaaaaatttcaatttattatgttttaagtttggaattctaatagcctttggttgtttttcattattgttcctatattttgtgcatgcagtgtagcaaaaatcaattattcactcttaacacttaatgtccatatatgcttgctcaatcaatcactctttttgcacctcgtagctagtaatcaacttctagatgccacacgtaatagtgcaatcttctgcactaggttttagaagttactccaatggctgattgtaacttgcatatcatctactctcaggaagcacaaagtgtcagagtaagagaaaacagaactcaaattcttctgaacgaaaagctcctttaaaaacatcagcatcaaaagttgacaatcccatttccaatagccttaagtccttcaccttcaatgatctaagagaggccactaagaacttcaggaaagaaaacttaattggagaaggagggtttgggtttgtctacaagggatggatagatgaaaacacatgcgctccaacaaaaccagggactggaattgtagtggccatcaagaaacttaaaccagaaagctttcaaggccacagagaatggcttgtatgtccaagtccaacacaaactcttaaactgttttctaactgcttggtcttgctaggtgttgactaattttcttccctttttgtttgcaggcagaagtcaattatctaggccagcttcaccacgaaaatatggtgaaacttattggttactgcacagatggtaaaaacaggcttctagtttatgagtttatgcagaaaggaagtttggaaaatcatttattcagaagtaagtagtacattcactcttcaacaatcaacatatctagtctcaaatgatccactgagtacaaatgtacaaatgggtggaaataggataggccagacttggctatgttaggcctgagcccgatttggtttataattacaaagtctgtttgacttgtaagcctaaaagtccttcaaaaaaatcaattttaataataatgattttatatttttattaggtgcaatttgtagtatatgtataatgtattatgtattatttatatataatgtaataatataatataatattattatgtttataaatagaccgacttatcagacttaataggtttctttaaagcctggaacttgatattttcactaaaacagctttttataaagtctaagtctaaccttttaatatacgggacaggcttgacaatgccctgaaccataatttcttctttattcacaatacctcaaattttgttttctattactgcagaaggtgttcaacctattccttggattacacggatcaacattgcagttgctgttgcaagaggattaacatttttacatacccttgatgcaaatgttatatatcgtgatttaaaagctgctaacatcctacttgattcggtatgtcacactgaaagtttggcttgtggatttgggaagaaaaccacacctgctgttttgcatgtaaatctccattctgaaagagtagcactattatttatgcaggatttcaatgcaaagctttcggattttggcctagcaagagatggtcctactggagataacactcatgtttcaacaagagttattggtactcatggttatgctgcacctgagtatgtagctacaggtatatttgcctttccatttttctttatctttatcaaagtgttagtttcttagcttttggatgttgaggtagaagcaaaacaaaagcaaggagcaattgagacaaaggaagatgcaatgatgctgtgttatactaataatggacacttgtgacttattttaattctaaaaattcatttggacaccaatttgaatgcatcctagttcactacactaatttcttagtccttggtataagagacctagtgtgtgtttgggaatcagttgaatacttgaattcaacgccaacagactttcacatgaaagctagtacaacttagttgctttgaagtttttgcattggaatgtgcaatttctccatttgacgtggtttcaacgctaatccaaacacaaccctcggtaacttgtctgtaacttcttcttagaggtcacagctcaaaatgaagtaatcaaattggccaacattttgaatatttggataaccatttcggacctacttttgggtgttgaacatacttttggagaatgatgctctttatttgaacgtaattttaaaaggggtgaacggtgatccaaacatagctatatatgttattatatatataaaaagaaaacagaaagcaaatcggtttatttcttcaaaactctagagtactctacacataagagacaaaaactaaataatgttccatttgctgtgatgttatgcacatgatttgtaaagttgatgagcatatatttttcccatttataataagttgctttttgaataaacaaacaggtcatttgaccccaagaagtgatgtatacagctttggagttgtgttgttagaattactaacaggacagcgtgtagttgaagatgatagacctggattttcagaagaaacactggtggattgggcaaggccattcttgagtgatagcaaaagaattttgagaatcatggattcaaggatgggtggtcaatactccaagaaaggagcacgggctgcaggagcacttgtactacaatgtctaaattctgatcccaaatatagaccaactatggtaactgttctagcagaattggaagcactacattcctcaaattcattcccaaggaccccaaaatctggaactgagaatcatacaacaaagcattctagtcattcccacacgtcagctacaagtagtagtaacaaactatgagctgttctttctctatgtggactaatgcttttgcatcacaacaagtgctttgttctttcagttttgcgactaagtgaataattttcatctagggcaaagcattattttattttcgggtcattgtcggaaagcattaccatgcttaaacaacggggaattattcatgtgatatcatatgaattgtttcaaatgtgaaacggtagtgttttgttaggagttcaaaagggtatatagttagaaaaaccaaaacttgtaacttttgcaacgttgtattcatatccatgtaaaatcacataatttttccttcatattaatcatcatctctccaaaatgagttgtaagtttctctaaaatgtttaaaatttactcagacatctcattaaacaatgcttggttgacgtaaaagtaaccttagaggcttagacaaattttacttatgatatctctattttagacgaagacattatttccaacattattagttttctctaaaacaaaaccattgttagttcctttggatttttttatcctccttttttcttaatctttatgaatgaatcttcctatgtttccgttcatgtttatgaagaaagacaaaaacaagtataataaaatgtttagtaatttctgttggatccattacattttcctatggcaatgatccctcttatattccttctatcatcacttgcatagcaaccaaaagaaaaaagttaataaaaaccactgatgatcacaatacatcgctatggacataagaacgtttagaagcttgcagaaaagtctcaatatataggaagcaaaattggctctaggcttaatcgttgaatattttcggtcaccatatcataaagggaacaataagttacaaagcagaatgttttgttttactgtgttgggaaccagaatatcaatggtaaaggtaactctacacaaatataaacctcggtttagtctgttacaacttacaatgctgcaatttaagaaaatttaaagaaataaaactagctccttacaagatgagcaatagaaaaataaataacaaattagagaactagattcttcactcattcttaccaatttcctcatacctcctattcggttatcacacccatcatataaccccctctctcctctctctctccttgccacctgttattttctctccttaaaccacatccacatgttacactcctccccacttctgcctgtgtgcaatttgtttattttgtcttccataatctctcgtacccatatacccatattcattaatttcacttccctaccactaccatatccatatatacagtgcatatcatactatagtgtaaaactacataaaacaaaatattgtgcaaggcagtatcccaataacaatatcagtaagcagcttgttacacattttgaagtatgctgctaacattcatacatactgcacaggaatcaatgtatatagtgaagaaaaagaaaaaaactacaaaatcggaggttcactcttctcttgtggtgcccttgtaataaggagccccaaacattacctaaggtgcatgcatgcatcacaaaagtttccaagcacttcaagtaatgagaacgaatatctcagtagtatacaaaccatagaggtcatatctcatatcttctcagtaacttgatctataaatagtctggtccttctcaaatttagcagggtattgccaaattgtagtactaatactgatcatcataagtatatttactgctgccaaccatactgttgttgattgcggtttccacccatcatgttcgagccacgaccagccgctgagcccccatatggaccaccttgttggggataatttggagctccaacatagccgctggcaccaccgccacgaggaccaccaccaggcatactattggacccataaggcgccccccgcccttgaggaggataagatccactgccataaccaccaccaccttgacctcctcgatttgggtgattgaatcctccacctgggttcccattgggaggatatcttccaggcccaccagatggaccccggggcttcccataatgatgcgtaggtcctgcagcaacttggggttgagaaccatgaactggttggtttggtcctgatcgcatttgggcatgttgcccaggctgctgaatggggggaagacgagtgtgaggctgtgggtgcggcattttctgacgcttagccatttcttcattttgccgttgttgttgtcgctttttctttgtctgaaactcatgtgatgattcgtacttgggtaaactaagccatacaaaagagaacgaagttgaaaagtattgaccagaaaaggattagttgagtagaaacaataaagtaaaaaggaaaggaatcaatgagacagacatttaatccttttaagatcacataatttcaaagtaacattctcaaaataaataactaatgtacatggaaggtctaacctcttgggatcgcacggtaatggatctgtccagaaatactcagcatcaagtgcatcttttgcagtaattctctgtagaaataaaattgaccaacaaatattatgatgcagatcataaacaaaattaatcatcataaaaccatgcagccaagtgacaaataataattttcttggttacatttataaatttaataattatttttgttacaataaattttcagattacaccaagaacaacacaaatttataaatgacagcacaaagataattacttaacaaaattcgtctcaactagcactatgccatcaatgttcaccttacataagtttctcacaaaggaaaacagatgtacaatatttttctcttaagcttactgagatttttgtcaacatacatgatataattaataacaaaacaattgtggatacagttaaccaagtaaagttaaaacagattgaatgataaaagatataactggaaaaacaggtatttgaagcacttaaaatagaaattcaatatcatttaacaattaataaatcagacttataagtgaataagtgatacctgagctggatcaagtgtcaacatcttctccaacaattccagagcatgatgatcaaaactataagtcatggggaagaagctattagatataatttttatctagaaaatgaattacacgctaacttctttggtggataaaaaagcctatatactttctgatacttttgctttgatacttactgcctgaaaacttccctcaaacgtcttttcatcggccttgttggcataaatttattataataaggtatcttggaaaccccaggccaattgacttcatttggtgctccacacagctcatatattttatttaattgttctggctacaatagttacaaacaaaacctgtattacacttaagctgtacgaaaaattatcgtgaatatatacagtaatgccatgtatattaaaagaaagatctagagtgaatgtaatgactaaataactgaaaactatacagcaggtttgatccagcaatgtacccaaacattaacattccatcttttcttgacaattaaatataaaaattgtccccacacctaacactgtttttcattttagtttctgcatggaaaaactctacattttggttcctacatgaaaaatgtttacaaatgaaaacctgctatttaatcaagtattaaatttggaacctatactagacactgttttttgtttgttcttataccaaaaataaataaattacactttgtcttggttcctatatgaaaaaaaaaactacattttgatctttacacctgacacaccatttttcgttttggtccctactccctacataaaaaatctctaacactgtattaactttagcaaacgacagaaaccaatttgaaaaaattagagattatggaccaaaacatagaattcttacagggactaaaatgaaaaacagtgtcactcacgaggactaaaattttaatttaaccaaaaattaattaagcaaaatgcatatattcaaaatcaaaatacataaacatcattgacctcctgaaagaaatgacattttccaagttaaacaattaattagcttggcacccgaagaaagcaatcaatgtaaagccatttaaatgaaaacagaaaggttattttatgctcgtgggttgtggcaactaggctaagatatgtttacaatatgcagtaaaataaatatggcagcaagtgtcaagagatcgaatatgaagagtcagaatgtagagaatatcttcttgcagccatttacaagataaaagttaaaaccatatatagcccataatcaatatcacaacaatcattcatcaatctagctctaatttctctgaactatcatacataaaacatcacttacctcatcttttccaggaaagataggcttcccttgaagaagctcagcaaaaatgcacccaacagaccacatatccacagctggcccatactttgttgttcccagcagcaactcaggtggtctaaatatagccaaaaatcaatatatgcattggccaatttgataactcatgataaaaaaatgacaccaattacctgtaccataacgtaatgacacgattagtaagatttgcattttggtcattagaaaatgatcgtgccagtccaaaatctgcaagcttaagatttccttcattgtctattagaagatttgagcctgcaacagaacaaaatacatcaaataggtataataatagatttaacattctaatgtaaaaacataatcttttaacacacagacctttaatatcccgatgaagtacttgattaacatgacaatagtgaagccctgtcaaaagctgtctcatgtaacacttaagaagggaaacacaactcagacaacaataaaacgaacaactattaatatatgaaataacacttggtattaacagtaataccttaatttggggaactgtaaatctcatcccaggccggtcagcaagacctgttaaatcatggtccatgtattcaaagaccatatagatgccacctttatatttgttaccatctgcaatccccaaaaaaagaatgaaaagcagatgaactaagtttagtatgcaaagcccaaaagaaattgatggaatcatggaaatattctcaccactagaactataaagcatattaagtgttactgtctagaaattggctaattaaacgagaaggaattacttgcctggcttcccctgttcatctttctcaggacctgaaagaaataacccaattttatatataaaacaaatttttaaatcctaaatcttgaaaaagggtacctgtatcagtcacaatttccttcagcttgatcacattttcatggtgtagtttctttagaattttgatttctcgtatagcagttataggaaactgcaatggcaaaatttacaatacagttcagaggagcaactgtagcaacagattttaactgtaacttccgatttaggttcactgaatagcatgtacaatgaaaaaaggttgtaaaagcagaggagactaattaggaaagcatacaattggagcaaaacacaaataaaatacattatgcacccataatgtaataaatactgaaatattcaaatcaaagatataccccctctctctcattgtccattcgtattttcttcagagcaacaatttcaccagttttgatctctttagccatgtaaacctgactgcaagcataaatatattaaggtatacatcagttcacttgagaaagtatcagcaatgaagtgggaacaagtttgtttttttttttctctgactgggtaaagtcaaaacaagagcttaaggaacataaaggggggaaaattgcattgctatgaagtatgaacaaagctaaaactagatgacattttaaaggtgtgatggagttgggaactatgtccaaagaagaaagcaatgtggcaaaaagtactacttcagaaacagacaagagacaagggaacacaagacaccaaattgcacaagatgaagatataaggttggtttggtggggaagggagaagggaggaggggaagaggtcgtgggttcgaatatcctgctaacaaaaactaacaaactaacaactaataactaacatcaagatcaatatcaatagcatctttaactcaagttaattggggaaactaacaactaacataagacaataaaaaaaaaattgcacaaacagtcaaataaaccataaagaaccaatcaaggtttttaaaaacagctcgtaactgcaattgcagccacaacaccgaggttttaggggtctctgcaaccacatcacaagttcacaaccacaattgcagctgcattagccacatatgtctataatttcccacgatatcaatgatcgccattaaacatgaatgcaatttaaaaccttggaaccaataaataataataatttttaaaaaaaagaagatatacaaagcaattaaacctcaaagcatcgaacaatagataactatgatgatttctccaccgataaaattttctgattgataatagctacatgataaagaatcaagagttctaaaaacctcacgtttaagttgttttcaagttcaacctagcccaacagaatctctccaataatcccaatagagtgttgcatagtaaacacgtataatagttaccattgacttcataaattttcatctacatttttcacaaagacaacccaaaataaaaacttgtttttgataacgtaaagcttaagcagtagagaaattgaaagaaacccatatgtgccctcgccaatttgctccaatttctcgaagcaatcaacacttctggatccccaaatgggtgattcattcacgttcagatgccctggggctgcaattgccatggctccctaatcttccaaggaacgaaactcgaaggcaacagcgaatcgaatgaatcagggttcctctagggtttctggcgcgcgaaatttatccagaaaatctctcacaaaatagataagctgatatttgattgctttaaactgaaaattctagtttagagaaaaataaaaatgtgtgatcattgaaaaagaatatcaagattatgatgttcaccgtacgattcgctcgtaaattcgatttcacccaattagacttttttatttgggccgaacccaattcaatttgtttaaatctgtttatgtacattgggtcacaggctttgctttttaaccgtattaattgaatttatcttttagttgttatccaattttattgtacaactatttctatattttttttatgtatacattacaaatcaatgaaagacattgacttttctattattgaaatcaagtacttcttaaacattcactaaaatgtttggatgatgcaccaagcaagtgccaaagtgagaaatgctaagattaggattgatctaatgaatgaggtttaaagtaactttaaagagatttttttttttttactttaaataatagtataatatattagttctttttgtcaatattatgatatattttgtccaaatatgaggtattttttgctttataaaaattaataattttttttttgatggacttaaaatttaaactttaacttatttaacttggatcgatcttaggtcacattgtcacactctttgaagcttcttttaattggaccaaatcatcatatttttaaaactaatctcctgttcaccaattgtttaagttttgtgactttatattttcttgactttgttttattattattaagaaccaaaacatagtctacccagtactgcagcctcagctttcatgggcagtgttttgtgtttgacaggagtgtgtggatcaccataaagaggttcaactcgtaagcgtagatcgtgaacgaacacactcaacaacttctccatcgctgcaaccaatgctctgcctccactttgcttttaccactgtcatctttggtacttctaacttttcaaaatggaccataaagtacataggttgatagggattcacgttttggggaacgaggaaagtttcatgctttagcaagacatatgtttttactatctttaatttcagggttacatttttgaaaaaaaaaaaaaagaaactttggaccttcttgagtccatcgttttagttcttaataataataaaaaaaaattacatagtgaccaatttaaagaatatgatgatatgattcaatagaatcaaatgtgagtaagattgtgaaactaatatttctctaaaagaaaaatactaaaaaaaaaaaactttgcagcaaaaatgcctcataaaattaattatattatgtggcaatataaaaacatattatcacataatatgaaattgcctctaccgtgacgaattttttaattatataattgattaaataatactttgaaatcttttttcaacacatacacttatgttagagagaaggtatgggcctcttcaagatttttcttttagaaaaataaaattatgaaaaaatttaacctcctgtttctataccattatttgtttttacagtttaaaccccaccaatatattgataaaaaaaaattgatgataaaaaaaacaccaatacaatccttgatggtcaatactataatgtttggtaaagatagttgactttgactttgaaacacaattcccatttgttttaaggcgatgataccactaatctaattttcatataaggataatgggaggaataccatcattgttctctttattctttagtttaaagtgaaacttcattagaaaaagttaacacaccaaaataataagtgatgcatttagttgaggctctatgaatccagtgcaattctataatgtcacatggtgtcatggtccagtgcaaggataaagataatgtagataaatgttgaatatttttatttcatagccatgctaaagccatttcgctttcttggctacagagccaattaaggtgcttccctgttctgtggtgatatagtcggcaggtcaataggacataaatttatgcaaaatgtgcaaacattccaatttaataactaataatgtgtaatccatccatcactttctggtcaaccacttttctccccctcaattcctcataaaataatagttttatagtaaaccaaattaatacatgggtttgttacatatatatatatatatatatatatatatatgttaatcataagaagtttatcgagtaaaacaaaacaaaattttatattttttttgttattatattactaatatagagtaatcatcaacctttgtgtatgactaattttatttaaaaatctgatttataattttttttgattttttttttcaatcatcttataccaacgacttattaatataaaattttatatttgataggtaattataatttataagtttgaatcctcgcttatctttttgactgtgctaaatataattttttataaatgcttttttaacctagaaacctttctttatcttgaacctaacatattctttcccctaaattttctgcaccaaaaactccttaatatttaaacataacttattttcgtccacttaatttttagtcgcccacttaatctcgagttgtccgttaaacatattatataagtgaaaatttacacgcgcaaagaaggtacaaaaaggacaaaagtaaagcccactacgataacttcagattaattgtacaagtataaaacttgggagattgcaatcaaactaattaaaaattgattgatgataacatattcacaaaggttcatttcatactgttagtaatttctgttgccacgaaaagaatagttgatagttgatatgtgcctagcacatgatgtttctaagcgtaattagatcgttaaatgcatcattttatatgataaaatagcttccaatcggtgtgaatgtaatttatgagcttcaatgaggtatttggtttagattgactgtttagcaggtgaatagctaaggaattatgcagagaagaaggtctggcgccatcaagcctatgtacaatcgggggtacataggctagttctgcatgatggcgccatcagcgccagtcccgcgcctggagcgccaccgtctctggaccttggtgccatcagcgccagtcccacgccaggagcgtcacaggtcgcagaatctgcataatgagggcaaaacagagatttcacgggctactctataaatactgaagcctcagcactgaagaaggaccttttggacgaaaatcaccaccaaaggaagagaaagagagcttgggagttgattctagggattgggtgtgaggggaagagggaaccctcttcttctttgcatatcagcaacatgcttctttttgttgtaccaaggccagccatgtttaggtttggctactttccttttgtatttagggcaaatgttccatataactttcatttggaatggattgaatgttattgttcattaatgctatgttatttcattacactttgcttgaatctctttatctctttcttagacctgatcaatctatttaagagcttagagctagggttcacaatagggatattggggctttagtcttggaactaagtgtggtgacttgctttacatcacctagggatagggatgtatgcttgcaatcctttctagtgcatcacttaatgcttaatctaataaatgctactaagggattagagtgttgaaaagggttaaagggttaatgtcactaagggattagggcttaactaacattgaatgaggatgcatgattgggtagctagtgtagatgaatgttgcaaacaatctatgtaagaatgttaggagcatggagtgtgggttccctagctacattagcttacgtttggtgcaaccattatctattttatttataatgctttatgtttatatttagcttttaatttacttcgcacaacaacacatttctcttaatcttttgtcatccaacctattgatacgatttatgatttaattggccaaacaatcctcgtgggacgataactctattttattactttattacttgtacgaccggtacacttaccaagttcgcaacaatagtaagtgcttaatttgtgtgcttggtaaaggaagtttttggatcagaaccagcatagttcacagtcctaggttagcctaacttgcacatacaggattaataaatgagtagtttaaaatataggcgaagcttcttacaattatgtaatttaaatcacaataatttttatatgtttgcatatatttatttatagtctttattgtcaattttttaattaataattataacttgttattttattcattaaatcttttgtgtagaagaatcaaatttaaccccctgtttaagctatgatactaagaacataaattcctatcctcacaattatgactcatgcattatcaaaatttataaacgacacctccaattttattttatttttttcgtctacatgatgtactgttaattactctgtaattaaacggaaggctggaaatttaacactaaaaccctttattgagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctttaaatttcatttatgattatctctcataattattttgtggattcaaatttgaataactttcattcatgtggataaaagaaaacaagtattatttatgacatcattttcgaattgtcatttttctttgttgtgacttcttattatttgtactcttaaaatttttgaatttgtaatgttgtctataatattttagtgcaatgactcctttttctctaaatgattacaatattcattagctgtttgattcttatccaataacaactttttttgtttacttttataattatctattgactaagaaatatattcatccattatatatcttgttttagaatttatatgatcaccctttgtttttcatcaatatatattataatattcaatcctgtttgactaagaaatacattcattcattctaaattttgttttaaaatttgtatgatcaccctttaaaggtggaacttcatacttctttatgaaatcaactagtatttgagattgtagattgaatcaattcccaccactatactgaatgaaaccccaccaaagatgttatgggtagttgttgtgattaaaaattcaatccacattgatttgacattccaaatggatttcctatttggcaaatatctgggtgaaaagaattatggaatggaaacataggaaagttcctatggccgagttaaaagaatttgaagcaattggaagattttttataaattgaaggtttagaattttgcatctaattttaaaaaaaatagattatattgattgagatgcaatccttaggaaaataaagggaatataaagttgagaatttgagaaaataaatagatacaagaagatgaaaaatgtttgacgtaaaattgtatataaaatgttatgaattaaggtatttaaaaatgagtttaattttcatacatccaatcaattttttttctaataagaaattgatatgtatggtattttattttcttttacaataatacattaaagttatccttataataattttattgaattttacattattaattaataaatttttttataaggatagcttttaaagtattattgtaaaattcattaaaatacacgcatgtcaattttttattcgaaataattgatcggatgcaaaaactttttctttatttttacaggtgctaatttgaccgtttgcaactttgcattccttgtatttccggacccttttcctactgtttacattttttactgttattttaataagtatttcctattatttttgtattctatttcctatacatttttctatttcttaccatacagtatagaatagaaacaaaataggataaatttacgtataatttattatgtgcttttacttcggtaactcacttcgtttttctcccactgaaatggtaaatcacacaaaaactgtcacattaataatcgacattactagttcttaaaaaaatacattagttatttgagttaaaattcgaattttaattaaaaataacacaaaaaaaattacaaaaggtgctatcccaaagttgtatccaacaaagattgatggtggcataaaagtcgaaagagacgcacaaaattaaatagaaactggtgcttatccgagcaaccggtgttatgacgtcatagcaatccttaattgcctccccaatgtgataaacttgctactaaaagcacttattaagttgttttccgtgagcaatttatgttaaacttgttcttaaagcagtaaaaatgacgtaccattataagcatgaaaactatataagcttaaaagaaagtatgaaaaaaatatataaaatgatttttatcaactcgttggatatttgcttttattggagtttttctaaagtagaaaagggatgcatgcatgcatctgattctctttatgccacttgtaagtttgtagttcaaaatagataacaacttaagtttctgagtacgttttctaggtactaccactttgatcatggtctaaccctgacttttacactttggcaagccaagaactatactatatattaactaaaacgcaattagactctggtggttagataaactgaattgaatttctccgataagttaaaatcgacgtatccacttcaactttcagaaaacttaaatgagggcatttctataaaagttaaatatataaattgattttaacttatgaaagaaaaaactcaatttattttattttttattttcctttcctttaattagttacggaggagtttatatacccaaaagagccttaatttttaattattttatttccaaaagaattagatacttcaaatgcaatagttgaggaatgtttagttggtagtgtacagtggtcctgcatgctaggcaaatgagggtcaatctatgatgaaggaattgaaggtcttcggttcacgaacactctaatgccaaattaagtcaatggaataagctagataaggaatgaaagtgagggtgtgagagacagagagggaagagtgatggattgatattactacaaacaaatggaaggttggttggtggtggtgtcaactttagctggactacgttttgagtataatcatgtatttatccttatggttgtgatgagttgacttgtgtattgatcgtggatcatgcaaatccacatttggttgggaaaaaataattattaagaaataagaatagcttgattaaatgtcctccaagcaagtaatcattatttagttttaacacaatacatttatcttgtatcttaaaataaatagtgtttgtagtcaaagtcacataattcatgaaagaggtcaatcccttaaataaattttaatatctcgagagaatagtccttgatttttggccaaaaaatatcctgactcaccaaaaaaaagttacatcactcacacaatattaatttattgtggaaccttttacatgggtgaaatactagataactaagaagtcgttatatacttgattgttttgcttaataataatccaattgcatattttgctccctaattgcttcatgatcaagtttaatcaggtgtgcatttttatctaggcattggtttttccacaagttgataaggcttctttagtggaggaatagtactcattgacaaactcccacatgggtctgcatcacattttggcaccggtatattgactcttgatgtgtggggaacccaaaaattttgcattattctgatgaatttctcttctagtaaacaagccatgtctacaaagatcaatcatggacggttaagattttctgctgaagtttctaatctatgactgataccaccctacacaattttgataagatctgcagctaaaccttttgtccaaagcttcatgtgtggtggtgttacggacccttctaattgtagccaaatgaactgtaaagtgtaaaagctataccttaaaattccttcttgtgttaaggtaaaaacagttgtgtaactgatgcaccattaaaactcagcaaaagtaaacccgaagtttgatagtaaaaagactcctcaagagactttttgtacaattaggcagcttgtcggcaagttgggcataatagaccccacctttgattaatgggaagagaaatgctgcttcatatatagttgccctctttaaaactacaatgcaccaacaaacctttttgtggtaaatttttgggtgaatgatatctcactcagagtcaaagactaatttcttgataattaatatttatttaaagaattaatctctttcaataaatattttttcatatataaatttggaaattaaacctctcgtcacatgttaaatattttttcatatacaatatacaaatttggaaattaaacctctcgccacatggtgaagaaacaaaattatctgtcaatcatatcatatcataccagatgattatatcttttgtgaaaaacacaagcactaggtaataccaccaccaaaataccattattaaaaggctttgtacaaattgttggcccttccaacaaccctttgtttttctctgtaaagttcagagtctccaatattctgtcttactccaactagctgagaaccatatatatataataattaatctaagttctaggtagcaaaagtaaaccaaagatagttgaagatgtggcgtcttctagctgcagtggcaagaaaccttcagaacacaagaaagagttccaaggtggcagatgagagcatgtttgaagcaggaaacggtgtagagctatttggacatgagaggggcagaagacaatatggttgggggcttgtgtgtagcattcttcaagcccccatatcaatactctcatgtgtttctcagcctcaggttaataatggctctgatggcgtttgggtaactggggaattctcacaagtgtctgaaatgaaccatctcatggtaagtgatagcatgaggtatgcaattttgatgtaggaaatattgtgaatatcaattattgctcttggtttctaacttctaaagacaacaccatcgcataactctctctcttgtcctcatttttcttttctcttctctgtttacagtttggatcatatatatgtaatacactaggtgattgaatagatcagccaaagttatgacctactttttggtgtgtatttatccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacaaaatcaaactaacaataaagaatgtgttagagtgcatgatgctagctagcctttttctttctttgattttaaccactatcacgaaaaaattatttgatgatcctgaaatatcaaatatttagagttttaatcaatttttatataacatgcatttagattttttaatttacagagaaatagtaacatttgattattcatatgttatgtgatgattaattaagaaccaaatagtttaaaactatcaaataatttctccttccactccaaaaccagaaagaatcatataatcaggtgatttcacacagcatttgaggaataataatgcttggattactaaatgcatcctaatcttgtgagttcatcaaacaaatgaagataataataaaaaatgctaagatcggagtaataattcatttaggggagaaattaaatataaatataattgcagtaataaaataaaatacataaaatttatcgttttgcttaaggtggtcctaatcagggctgcgcaggagggcaccaacatatatagaatataattcttggaaagcaattggtgatccatcatgagaaccctaatagttgaattcatttaatataagggtacccacagaatgccatattcaaaaaattgaaattattgatgcgaatgtaaaagtgattttgtacgtcatttgctgttcatgaataaattaaagaaaggattcaacagtataacacgtgaaaattattaagggaatatataaatatatatatagttttcactatcagcttagatttttggatattacctattgatttagtttctcttaatttcccattcttttcaaaagattttcgatacagcttattgattacacttctccaaaagtcgtctctctaagggaactttgatcttaaggcttgctaagtgaaataaattaatcttaattatataactacacacaaataattttttttacagcaataactatacacaaatattgaatattactttattgaatctaatttttatcaccgattttaattatacgatcaaatctaaattcttcatgtcctatcgtctttctcttaatgtgttatatatgtgcggcattttggtatgtgagaggcattatcgttacaaactcgtgacctactcatttctccactattgcaactacctaagctctaactctctctgcagctttattttcgatagtgctaaggttgcactttttactgaattttcaataaaaaaaaaaaaattcgtagtgtacaattgtatacaattgtccacatgcaagtcactaattcatgcaagacaatggaatcaatatatattgatcagcaattacaaaaaaaaaaaaaattggtttagttaggtggctaggattcaagtttcttaaccatgtaattttaggttcaattttgaattttgtttgcttatgaaacaaaatattttgagaagtatattcttatcattatcattaaaatctatttatattttacaaaataagtattttaaggattaagtaacccaatatatactactaaggaaatcattttgttaacccaggttatgtttaacaagattacctaaaaaattaccttgaaagttggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactttttaaggtgaaaaagaaaagttgtggcagttttaatttattagaaaagatgatggaaaaataaaaatattatttatgaaaatagtcaaaattaattatgtgatcaatgaaaataaaaacaaaatataataatgttaaaaaaatttagataataaactacttttattttcactaccttaatggttttaaaaacgttttacactcctaaatataatatgccttctccttgacggtgtgtttattttaaagaaaaacatgaaaggaaagaaagtgaaataagaaagaaaaaaaatagaagattaatgagatgattttttaaattatttaaaatgagaaaaggatagttaattttttctcttctttaattatgtaaaaagaaaatagaataaatataaatactatctataaatgaaaagaaatatataaaaaagaagacaatttaatctttttgtaaaaaaataacactcatttctttacttttccttccacttttagacaaattaaaaataatgtgaatctagttagccacttgcacttcctttatctcacgttatactttgtacttcattcgtgattaattataagattttttttaattaatttatgctttttaagaacaataattaattttattaatcatattaaatctattaattaattatactatctttttaaaattatcattttcttatctttctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattattaatgtttgaagaaaataattaagtaaatatatgttgaagaaaaaaaatcaatgcatctgaaaattacataattaatttatataaaaagagataaataaatttctaaaataattttataattaaagattgattacttcggaattgatagaaagatatagaaaattatgttttccttgttttgtatttcattccttcattcatcaacctagcaattgtgagaaataaatataaatataaatgcaaaaatgaaattattgatgtgctcagtcatgagcacaggtggtaataactgttacctgtacaattactgttatccgtaataattgggttctgaattttccttggtttaatttggtattatctattccgttgattgacaattgacattagtaaaccaacatttatagaatgcgttgaagtcttttttttattttttattttgttatattattgtttcgaaccctatttctgtactacgtgggatacatataattacaagtttgaatgaccgaaaaactagagaaaatgaatagttctgtcaaagcacacaagaatacattatggtaaataataattaaacaccctgcatacgtggacagcgtctgcaacactaattttcagaaatacacgattcatttgtacgttaacacattgttttaccatcgatatatactctcaaatcttgttcgaatttagtacttttagaattattatgaatgagaaaattttatctttaaatatttcatactattatatatacatgaacctttataactcaatattaaacttttattcgagtgaaaaaaaggttgaataaatttctttaaaataatacaaaaaaattaaggcaatctatgttggttcttcatcatccatttgaaactggttttcacaatcaaaccatctagttcagttctttgttagaagtaattaatggttcatcattcatgtatagcatgcatgctagaatccgcccccagtatcccactatcacaagaaagttgaagttgcaatctaacatttcctactagctactaccaacttgctttgtggcttaatcgaaacaatggaaagactttatgaactctggctaccatagtacgatgaattcttgtagtagcaaatcaatgactgggatggtgctaacaataggcatcaacaagcgaacgattttctctcttcttgatcatgcaccgagttttgtattgtcttcatcaaactttcttaaagataaattctttttcgtgaggtaattgtatgatttttcaaggtaaaggagtcccggatcaattaacaacaaagttttaataaaagtaatccccgaaccatattcttctccaatctgagttttgctcacatctaaaaagcctcctacccatttatttatgttaccatcttctgttataagaactagaataaattactgtcagatgcaacaaaaaataaaggttgcatagggtatatatattacatttccgtgattctctattaatctcatgcaactatccagctaaactttaaatcaatctatttggagtattctaaaaaatttgttgcatagattagtattctattttatgttttctagagtttgagagtaatgaacctgtgattctgattcctgtgtgaggttaattattcctattttctgtaatgagatgcctagttgcctatcagcttcttcatattcatatcaaatccaaacatttcaattgacttaattaatatctcaaatctatgatgcacggatattccaataaggaattgttgccatgtaatgttagataagatgcaactctttaaaccctaacggaaaagttcaaacttaaatttgttgcactgcccatgctccattgtgagtttcattctctctacttcaacacttctttcaattaatttgcaacccttaaaaaaacaattaatttaattaatcatattaaatttatcaattatttatattatcattccaaaattatcattttcttatctctctatctacttaattgtttttttttaatatttgaatagaaaataattaaataagaacatgtaagaaaaaataattaatatatttaaaaattaaaaaagaatcttataaaaaaaaaaaaaaaatttgaaaatagttttataattagagacacaggagtactcttttacttaattacagcttgagttcttaggacctctaaggtaacggactaatggctctcttagctgcatcagttctttatttgtcttcttcctcccttctttacttctttcataactttttcctctcttctgtgtttctttctacaagaccagttctccatttcaactttcaattagattcagccagcagtgacaagagaatgcacctggccacgaagtactactgccatgcaaaatccaaccaatacctcaaatgttgcatacaatttttcaaatacagttatgaatggagggattactagggccagaaaacatctgattcgagggaaaagaataccattgtatgtatatcatgcctcaaaaacctgagcgatcctaattattaatcggttgaaactagaaagtagaaagtatgtaaataatgataaaaaaaaaaaaaagccagggctaaacaaatttggtatcagattttgaggaatttaacataaatcatataacctgacactaaaaatgacagaagagacacaaaactgataatgtcaagttccaaacactgcccatcaaagaaatcaaagcaaaagacaccaattgataattttgcatgccacaataataataaataaataaataaataaaatttttgccaaaaagataataaaccacaacagattaagataatgtcaagttccaaacactgcccatcaaagaaatcaaagcaaaaggcaccaattgataattttgcatgccacaataataataaataaataaataaataaaaattttgccaaaaagataataaaccacaacagattaagcttacaagaaaggatgtaaggaagctcatagggaaaattactaggtagatgtatgaagcaaatcccttttaactctgataactacaatatgtttgttgcaatgactactgtccatggccaatatggtactggcattaaacccccaagccatcatgaagtaagcagtccatttctcaatgaatttgagcacattctcaacttgatgagagaatacagcaagaagtgcataaaacatatgatattagatcatggcagatgacaagaaagtaagaaagtgccacatgaaacatataactgagagcaacgatttcatatcacctcttattctgcaatcatattcaaatctctttgaatagaaaatcacgtagataaattagtgacactaacaactactttatcaagattcaaaatcaatcaaaattgagtactgattcatgaataatctgatattattttttattgtgtgatgacaatagcacaaaaagaggataagaagcaaagcttctaacattaacgattcagtatggagaataaaataatgtataaaagctatgccaaatatcatagcttatgtcaatctagtgtgatgaataatacaaggtggaaacatatttgatttcccaatgcttccaccaaaagaagaaaaggaggaggggaatagagatacaaggatttctaacaattaaacagataaactaaaaccaatgcatccaatgtagcccatttttccaataaatgaatagaaatcatattatccttaccaaaattggatgaatcattctacatctttaacacattattggaccttgaccaattctccttaaatgaatattctattgattttcatcataaaatccttttcggaacatttcttcaagccaccgcctagcctcatgtttcctcccatgaaatgagaaaccacgtaccatgatatcatatgtccaacaattaggttgataacccctttgacacatccgagcaaacaacaaacgagctttgtccatatcactgttggctacttgtttcagcaacaaattgtatgtgaaaatattaggtggaaagcacttctctactaatctttccaggtccgcaatataatggctcactctgagacgaccagaaaatgctccaatcatccagcaaagtgttgaattaccagaaaataccccctcttccacacctcttaaataaatgcatgtatcgtagagttgcggtgaaatcaaagaatgataaagaagtacattgccaacaaaagaacttagtggacgtcccattttctgagatacattaatgatatgtattgcttcactatacttttgcaatgagcaaagcttttgcacaagtagctcatagcattcaaggcttggattcaatccaactcttaacatgcagaaaaagtactcacgtgaaatgtctatcttattgaacttgcagagaccagtaatcaaggcaacatataacttcttagttgccaaaccctggtgccgtacaccattaaaaaaattcagagcatcagaaattctcccattgaataaataaccatgcaacataagaataagagaagacaaattgggcttaataccattcctttgcatcaactcaaatacttccctagccaactcaggcttcatagcatgtccagctccgtcaaggaaaaagttgtaagtctgacaagaatgttgacaacgagtcagcatctccagtagattgaaaaagcgccctcttgaattatccatttcaagcaagcggcaaataacatctctacagaatggacgaatcagcttatgacccttccctttcatttcaacaagaagccgagcagcaatatctcccctaccagacttaacaaaacccttaatcatcttaacatacgatgtcctggcagcaacactcttaagttccccatgtaccaaataaccatcttccactctcccagcccggcacagagccaatatgtacttgtcatacattgacgtaggaagcacaatattatgccccacggcaagatacaacaactccttcatctcatcaatcttgtgctccctgcacaaagcactcgcaagcgtgcaaaatgtccgcccatcaggaaaataactccgctcagccgagcttctgagcaccttgaacgcttcctcagcgcccccatcccagcacaaagtaagtatcaaatacttgcaagccaagtgactgagagacaacccaaagtcagacctcgaatggtacaactccaacgcgacatctgccatccccactttgcaaaagaagcataagacagcattcatggtaaccacatcaggaggaatgcaactctcattcatatccaccaacaaatcatacacctcgtgaagccgattctcctgcaaaagtctacaaatcaaaacattatacctaacagtggcaggaaaatacccttcagagtccttcttctgagagaaaaactgcaatgcctcatccaccctcccaccccgaacaagaccctttatccaaaccccataagcatgatccaatggaaccaacccagagctcccgacttgcttaaccaactcaaccgcacgctcaaacctataactctcacacaatgcatcaattaaaaaactcacttcaggcccttttaactcctctccacgacacatcaaaccattgagaaaaccctcagcctcctccaaccttctctccttgcacaaatgcttaacaacaatgacatttgtcatgtgattctcgaagcccctggcgcgaatttgcctcacgatgatgtcaaacgcgttgagatagtttttctcgacgagggcgtccaacaggacgtggtaggcgaaggaatcaaggtcttggccgtggaagcgcattcggccgaacgcgtgaagggcgttttggggttttccggcgatggcgtagccgacaacgaggatgtcgtggaagcggacgcggtggtggaagatgcggcggcggaaggagtcgaggaagtcgaggacgaggggcttgaggtcggcgcgggcgaggattttgaagatggcgacgaaggtggcgcgggtgtggaagaagtggggctggcggccggcccagtcgaagaacttgaggcaggagaggatgtcgcggcgggcggcgccgtggcagaggacgcggaggacgaggcgctccgataaggggaggcggagggcggagagcgcggcggataaatcctcgtcgtcgggggaggagatgatctggtggatgcggttcaggaggggatcgaaggggagctgctgctgccgcgccgccgcgaaccacgtcttgaaggaggacgcgacgtcgttttgggagatagaaaaggaagttgaggctgaggatgatgttgattgggagggtgatgatgatgctagagaagtgtatgcagcatggtcaaagcacgggtcgagaatggaggagatgaaggatttggatctgagacggtgtttagttacatgtttgagtgggagcatcatggatcaatggaattggaatgggaatgttcttcttcttcttgtggtggttctctcggtctcagggttccattgcattctaagtgtttgtgtttatgtctctgtgtgtatccatacctgcggcttctcactacttcttacatcgggtgttaagggtttatggggggtttcatcctccgtaaatgtctaaatgaacttaacctgttttgatcgactcactgcaccacccccatttgtggtttgaattaggtttagacattatcaatactactagaatagtagagtcaggtcgtgcagctcagatttactcactggatcaaaaagtaaattcatttgtcaggggaacttcaaagttcaaactcagtttgaaataaaaacaatttgatatcatttttttttttaaaagtacgtttgatgttaaaatttaatttgaaaactcaattttagaaaaataacaattgaaatatttttgtaaattcagtttataaacttaaatttaagtttgcaaattacaatccaaatatacatttggttgaaggagtgtttgtttctaatttcatattattttcacataatcacattgcgatgaatattatgattcgaaatgttatttttggatatatttaaaaatatttgtgattatattttaatatttttagaaatatcttttaaaattcaaaaaataaataataaaggaagtttatggtatttttgaaaataacttctcttatcctcgtgaaatatcttattctcgtattgttcatgggaacaaagtgtaaaagaatatattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaagaatctgtagtggatgtgaaaagattttgctagtgaataatttgttatatgatattaaaaagatattactttaaaattaaataaaaaacttgaaaatttaaatttaaattttttgtttcttttttacatccaatcaacttcattatccgatttgattatctagtaataaagattatcaaacctacttattactaatctttccactcagttgtattatcaatttaaatgtgataaactcttttgccattataaaatcaactcaatttaccaaaaagaaactgattctagtcaaagacgtcatatattcttcataattagccagggaattttctgtgcagttctccacactatacaatctgaaagtcagaactcaacgtatagacatcttttcagctattgccgtcagcatcacctttctgtttctcagaggtaaggtaatcaatgtttttaagatttgagagttttgactctaaataatagttgaacgagttttagcataagggggagagaggacttaaaaaagagttccacacagcaaaactcttaaatgtagggtgttttttttagtacataatactcccttctcttttatataaaaaaaaaaaactcaaagtgtttgctcttaaaaataaataaaatttgattatttttattttcatttagcatgcgttggaatttctattaatttttatttttatttaaaataagtagtagtcatgatgaactcgttcccacacgagaaaagtaatggtgacgatgatcaagatgatcagtcaacagaagattattcttttctaaagaaaggaccatggacagcggaagaggatgcaatattggcagcatacgtgacaagcaatggagtgggaaattggaatatagtgcgaaagaatactggactagctcgttgtgggaaaagctgccgattaagatggacaaatcatctgagaccagacttgaaaaaaggagcatttactgaagaagaacaacgtaaagttattgaacttcatgctttactaggaaataaatgggccagaatggcacaagaggtttgttcttttttgttatagatgttttgtctcatccatgataaaagaagtaaatttcataaacaaggactaaacgtgaagttatttgagtccttcgagttgaaccagcagtggtcatgcgtgttattcagttgtatgtggttaatcatctaggtaaactcaggtcacagatacatccgtaacatagatcattgtcgtcataacctattctctattatttcctagaaacaacattataatcaatctaattcctttcttaaagttatgtataaggagaataatttccatttttgattcattaagggatagtgtttttatattatacacaatgatgtgtttcatgtagttttattgaattttgataatatattgacggtgaatacgtgaaacaaattaaagtatcggtgcttcgtaaatgtttacttgtgccttcatttgcatgtgttagatgcctggtcgcacagacaacgaaataaagaacttttggaacacaagacaaaagaaaaggaaacgtgctggcttgccactctacccagaagacatagaacaagtgttgaatgttgacagcccacagagtagttctcaaaatgcttccacccaacatgctaatgactcacaagtaggcacatcatctcataatgtaccagaattgatattcgacaattacaagcttgtcaatcgaaaacaccccgtgtgtgtaccacccatttcaatgatacctgctgaaaacgacagcatctttgaacaacaaggtaattcagataaccaaattatgcatccccccaagcagcaaattatgtatcgtccccagaagcagcttcatgactcagacatgctaccaattgattagtaagtatgagaaattttatgagcttcctatgttgtgtgtttatatttttatataacaaagtaatgtgtagtataaagtttcagggtgattacatgtcttgtggaacttcctcaatgtcagggccgcctccatttccatcatttgattactcattgagagtgagagaggatcctccgactgagactcatgatcagtactatgaaccacgttctccaggcagcaatggttttttggaatccatattttgcccaccaccaaagattgtggaaggatcagatgattgttccatgcaaggagagtcaagtttaggaaacagagaaaattcagaccagataaaccaagatactttaggtgactctagtccggtagaggattatgacaaggatcgagatgctcttaaggatactttatacagcattatctaccccttttttccacactaatatataattattcttaaattgcagaattttgtaagagctattaataaagctgaggggcttcactctggtggaggcttctctttttcaaggctccatcatgagtgacagaacagctacatattcttctggctcataatataataataataatattattattataataatattattattattgtcttattactcttatagtttcattctttattttattcttaggggggtcattgattgttatgaatcatgaacattgtttatttttctgagattgtatatatgaccctttttttttaatgtttacagcaactccttatgtgtattcagtgttatatatttatcgagtaactcagtgtaatgcatataagttggttctgggtgactaatctcaaaacttaaaaaacactcacaaattatgtactaaagatgtcttcggttgcaaaaattgatttcatatttttataagatatgagttcgatcaattcttatcagctgaattaatttttgtttgcataaatttaatttactctgtcttctattattctatgtgctttaatctcctaagctactcaattttatatatgttgtttaataataatgatattttatatcttatgtcccctttctttggcgtttctccactatgcagctggtcttttaattttatgtggtgttgatcttttaaataaaattattatagtataccaagtaattaaaattttagtaaaaatactaataatataaaaactattttgaaggggggttagtatattttgttcttgtttactatattttgattaattacaattatattttaactaagctaagataattaagataaattatattattaattttgggaaatattaaatatttaaaatgttactttatgaaagtttagggaatacttcgaaatttcaccatgaagctagcaatcttaattatggtgattaaaaaaacattaacaaactcgataaatagctaaattgactttgataaattgataattaaagatatattttcaatcgaaatatgttatcttgaaaaaataataccatgtaattgctttcaaaatattttccattatcattgtgatcctagtatcctctcttctctctcttcttctcgtttatcaagttatgctctttcatgttgtttccttccttagtagtaggctcatagcttatttctttttccatctttttagtttattttatttttctccaagggaagatgatgatgaattgatgatatcttattggaaaaaatagagaagatgagtaattcacattttgagttatgtgaaaatggtgataaaccacaggctgatgatgatgaagggacacatgagaaactagctaactacagcaacacaccagtgtgaattttgtggcaagaagtttagctctggcaaagcattacggggccacaaaagatttcaccttcaagctcaaaggaaagcattatgagattttatgcttttgtgtattttcttcattattgaattaagcaacaaaaaagtcttatatagagtttacatgagtagaaattttgctaacaaaataacaaacccaacaaacagatcctatattcttatatagagtttaaattctgctaacaaaataaaaaacccaactaacaaattctatatctataacataaagatattattgttataacagataacatatcctataacaataacaaccctaactaacgtaaagatatgattgttataataaatccattctataacagaatctatccgtattagaataataactctaatggcaatggcatcattcccatccaataagtccttctacggacatataagatcccattctgataggaattggaagggcattcaccctgctctatcttctctccccctgatcataagcatagttctcactctaactcatctattgaagagagcaaaggttgtttcaatgcagatgaagagacagctactgatctatcaaaacatttgcaaatgcaaccaagatggcatattaccaataacaaagatggggtacgcgttgatagtgaagaagatcgtgtagctgctcaacaagattaatactttattgatactgaagaagtagaagaattctgctatgctgttacctttttgttcaagagtgatgtgttgattcatagggtgtttaggcataggtttcatgtacaccaaagtgtttaaatgcatggatttcaagaacactagtcactagatagtagatacgatttaataattagattgatgatgttggagaatgtagattttgctaaaatccagtattagttatcattttgtgatataaaaaccaataatatttagcactattattactctatgaattaagacagatagtgatcaacattagctaatcttaccatcatattgtggatgtgaccaaagaggaataagatagattgacacaaaaacggatgatgtgtaaataatatacatgggtatgactttgaaactagtttctcacatgaaaattactcaaagtaaaaaaactgttcacactgtattcttcagcccctccaagataaaagtttctagctccaccaaaagatgagcatctttccccacctttctgatacgccttggtgcataagcttttctgttttgtttccattttgcttccaccacaagtaatgtcaccatttttttcttctaacttctgtttcggtatcgggtccctctccttcccatggttcatgctttctttttgttcttcatcctgccagttttggcttctttgtgttcgactttcgatgtgctttatactattgtctttttcttctatgctcggctgatcaggagttgagaacccttcttcaacatggaggctctttagggtttgtccttgttcctggttcatctgattatctcttccttgacctatcattttagatgctgagggtcaggaggagaaacatgcaataaaacaaagcatatgctaatgctaacccacatgtgaaatgcaaaaatgaaaacaattgaaaatattggagcagataaagatcacatggttatattatgactagatgttaaatctaaaagtattctagtacttactgttgggggaagtctcagtgctgaagaggtaaagatcatgttcagttgaagtatctggtagtggtatactatctgtgtatgtttcatgggtgctaccgggacgcgtttcttggtggaggtgtagtggttctcttaaacgtacaattttattgaaacgccttactcttaatataccacaagaaagcttttggaggaaatactcctcatcattcttcattttcctgtgaccacccagatgcatcttacattaatatgaggttgtagttagataattcactaaaaatgggttaggattttacactggaaatagttacattgtttgtcatcttatttcattgtttaagcaaaagaaaggtatatttgtagttacctgcatcctaaaataatttctagctcttaaatttgagaatgctgcactacatgtatgtatttatatagatttggtttcgaccagtgtataattttcaaattttttttgtaactatgttatttaataaactagtacaaatacccataactaaatgaaaacatcccaattcaacttcacctacgttgactaattcataagttatctatcattttgtctttcttctttttgttcaatgtatacttcaatttaagcagttgtattgcaaggcctaacttgctattgcttgagtgagtagcctgaatgattatctaggggtataactgagatttagattgatatataatagattttgactaaaacaaattatatgtcagaattatgttgtgatcttgctgtgagttagaaccagaatacttgaaattgtaaaaggtgatttatttataagtaatgcccaaatctaagagctcttttagtagaaaggtatgacttgcttagacattatgccccatagaccttagttaatggattttattagattatctgttttattttaacttgaatagtcttcaaatgaagggtttcaaaagaattatatcattcttgcatgcctagtaagtgtagaatttgacatgtttttgttagtccatccatgagactaagataattcagataatcaatttaatttcatttgacctagttgcctttagcatcatggctgatttcaatgcaaccgtcttcagtgatgatcctgcagccgtttctatcttaaatctaacctgagaatatgatgtgaaaagtttcataagatggaaaaacagcaggtctagttctcttaaaatgatttcttatcttgagcaaaacatgtgtggtagaactatagaggaataaataaaacaacagcttaaatcattgaatgatttcatcaattatttctgtttataaatgttaattgtacttttgagaaacaatgttacaaggagtactaattgtactttaaattttggagaagcaccgttccaaattattgtttctattcagtttaaatcattgaatgttaattgtactttggagaagcagatgtgtagatcattcaagacctatgtttagtgtatgtatgtttgatatactcttactttagaagattgtatttttgatctgcaataatttgaattggagaaatacttgtcggttcacagcctgcaactacaagttgtagaagagtgttgtctactattttctattagttcttttaagtcataaccataatactgtcaacaatggaaatgattttgttttcgtgctaggagtggatggattctttataatttggtaaatcttaaatatataaaactcattttgcctggtaggcaacacaagtagattttgtcactggtttttatcaaaacgtaaaattgtttacctagatgagtaatgagttgtattagttgcaataatgaaaataatagaaataggagatctgtttttgttcttctcctactcttattttgtatattgtttcactttgtcatctggttacactttatacaagttcacaagcaaaacaatgacttacgtttttgggaataatgtatactcattcctgtgggaaacttttgacaacaatatccacattttggaatcttgaatactttgatttaacagttggaagttagaatgtactaaaacaaatatcttttggatcactgcttactcaatacttcgtagaaacaactactttgtaccaaattgctgagtatgcttttgatattataaccccctccaaccacatagaaaatatcaccaatatatttggcacaccttttccgtatttttacatgattaagttgcattgagattttggagtagaaatagtatattcaccatatatgtaatagagtataataaggattaagcttactgccgcagagaaatttatcaggacatcttctagtatcatgtccaaagaagtcagctcacaagtaactctaatcacagaacatggtattgaagggaagaaaaaaagttaggtaagggatagaaatgccaacttataagttgaaattaggaaacaaatgttcttaaaacatttttctagtctaattatctcttttaaatatttagtagtcaatatgcaagtcatattttatgttttctaatggtcagataacaatgtaaagttcatggtgaaaacaaaatagagaaaatcatttttttataagctaaaatagagaaaatgttattaactagtatttatacgaccttttgtgatttgtatagtttaaaaatccgaccaatctccggattgttcagatactcttccttcttcctggcagcttgtgcctcaatcatcttctggctagctccaaacattaacctgctgtccacactgcttttgtaacccactacaacaaaatagatgtaaagggaaccaataattggattgattagtgaaattaatatcttcggaccaaagtttgcaatcaggttactcaacacaaatcttattgacatattcttcttttattttccattttctttcttcataaaatggttttgagaggatgaataaaataagtgtgtatttgatttctattttctaaactatttttagttttcaaaatacaactaaaaaagttgttcaaattagcatctggtagtaagtggtgcaaggcacaaaagagtgtagaattgatggagaagttgaacaagatgaaaatagaagaatatgagaaaacatcacttaagtagtttttggattttaagacacttgttttagaaacagttttcaacatttaatagatattggatgagaaactgattgttgagtagtgtagaattgttctagcaaacaaattttaaaaccaaaaagagagaagatgacttactgggagtaataacttggtgcatgactgcaatttgtgtgagcatatctcctggcacaaataacaagccatgtagagaccattcaaagattttaacattgattgctctagatgcatcatggatcacaaccacgctttgcccttccatgtcaatgacttcaatataccttattaaggaactccaactttttattacacaagtggttcaaggaaattgtgtaacaaaagtaagttctagcagcttattaaagtatgagtttcccaacgagactttgtgttgaagagtgtgtgtccaaagtgattttatcaatgagtaataatatcttaaggtaggatttcttgtgcttatcaagtatcctaagtaaccccttaaaaatggttattcgggattggtcttaatggttctgctttggcaaaatctaagctcattgctctatagctttcgatgagaacgaatgacttttcctggttaagtaacgaaattaccaagcattgccatgtagattaagtattttcatattattatttcattacttctatttgttctctttcaatcattttgtcatggagctgcgacatatggtacatgtgttttttttagaaagtagaacaaagttgtgatgacgtgtaggcataacgtataaaacaaatagcgatatgtgaagtgggaactcgtaataaaagagcaactgaaatttgaagtatgtggttgtactaatgtgcaagatttgattctacattgttttattgctaaggatgaatttggaacaaatttgatgctaaacaaacacacttaaaatcatagttagtaaaattggatcggatcggcctttggaccagttggaccgagaatcgatagcacaatcggtccggttactattggaccggttatgcagttgacccgatcaaaccctgtcaaaattgatccgtggaaccggtctggcccggtcggattttatttttttgggggggatttttttaattttttatttattattaccaatagttattttgaattttggagtatgaatgaacttttcttactcaaataatgttagttatatacttatatataatagataaattttgatatatattaggtcaaaccgattcaattactaaatttgaataacttagaaaaatattagttacattaaatctttcactattcacccaccacaacaagatatatcatcataggatagaagcatggaactataataaaaaaaattaaaaataatgttgaacaaaacactaaataaaataatgttaaacaatattacaacatactaaaaatgtattttaagtgaattttactttatttctagttaattgaacaaaacactttaaagtcttaaaaaatattaaaaaatatcaatagattattttttaggtggattaggtgagcaaatccgtttcatcaataggttattttccttcattcaagacccacaagaaatgctattatttatctctttttttgtattattttcatcttcatttttaaattagatttaatatttctttaaaaaaatatttctcatatagaattaaatatttaaaattattcatttatcataaattttgttatataaaaaatatatttatcatgtacatttcaaaagctaaaataatagttaattgcttaattataatcaagacactaagaaaattatgagaaaaaaataaaaacttaaagaatcaaaatgtatcaagtaatctacttatcttccttattttatgtcatattcacaataacaatcacaataaactcattataattattttataattgatataatatgctatttaggggaaaattaaactttaaaaatgatattactaaagtaaaaaaaaacaaaataaaataaactccataaatcactttagattttaaaacagaaatttgtttttcctaaagtgggtctggaacgtgaatttgagttcagaatagagaattgggactgatctagggtttgtgactgtacatgctataaatataaattattgagcaaagaaggagtgtctctctttttcactcactctgcactcactactactcagcactgccactcttcaatcacactaatggctgtcaccttctcagatctacacaccgaagagggcatcaaattcctcgatcaattcctttctgggaaaacctatatctctgggtaacactcataaaatcaacttaatttttatgtgaaaaaattgattttttactgtttctgacattcgctttattgaatttgtatatgggtttcgagtttagggatcaattgacaaaggatgatgtcaaagtgtatgcagctgttgtggaaaagccaggagaagactcttttcccaatgctgccaagtggtacgatgctgtctcttctcaacttgctccaaggtttgttcctctctcacttgttttcttttttcctgctgcaaattatagttttgtttttctttattagattttgcgaattttgatttttgttaatttcgatttttatttgagtagcttccctgggcacgctcaaggggttagattcagtggcactgctgctccaactgaagctgcacctgccaaatcggtatgctttttccttaattttatattttgttgttgccttatttttaaaatcgtttgttatattgaaaatgcatgtatatatcatttagtatttgtctttttttagtaatttagggcgctcgatagctagacttttaatttatattaaaatatgtgaaagttacatgggatttgttgttaatacttaatatgaaactaatagcaaaagccttatcttatcttaattagagtgactgtgtgggggtggttgattgccatgcatattgctattatgagggggatatgggaatgagtagctcagtagaaatgttatgtttattttcatacattaaaaaggttgataaatgtttagtatgtatcccattgtccggaaacttcacgctatacacaggtaagggggagggatattgtatgtagccttacccttgcatatgcaaaaagattgtttttggattcgaacccatgaccaacaagtcaccaagacacaactttaccgctgtaccagggctcgccctcattaaaaaggttgataagtgtatgctaaaaaaatttaagccattggattatgactgcaggaccttgcacttgcagttactgttctgactgcaggcaatttggttccagttagttcatataagagataggaattggagattgcctgcaatcagtgtgtgaaagtagaatctttactggctattttgtttttcaaacttcataaatgaaatataaattaaagaaacttgagctgcaggatcatgactgcagagttgactgcattaaaattgaatgtggagaatcttggtctaaaagaaatggaggatgctgacaaccattgtctctctctttctatatgtgtgtgtgtgatttttgatctggattttccgcatttaaattttatgcaatcagtcccagtcatgatcccacgcaatgttattagactagttcagggcacttgatcactgattgaaccaatgactggatgaactggtattaaaaaattataaaaaaaattcatagtatgccactatgccttaaaaattataaactgcatcacacctcttatttttatctttcaatattttgatcctgtaacatgctaaatttaaaactatcactctgacaaaaagagaaaacatgtttacataagtgaaaagttaaaaccttagatttgcagttgaaatagaagacaaagcaattagagtgttattttcttttcagaaaaatgcttccataatttactcatttagcatctgtttcttttataagatgtgaatttgaaatcaattaatccatttgggtgaacacctaactcgaagtactttgatagttttagaaagaacagagcttgattatgtaaccaactaaccatattcatatgtaacataacatgtttactatatagttcctgaacatgataagtattagccaagattacaacatcgaaggcacattttagagttgaatagcactataatttgcttttgacttcagatagttactcaagttttatatcccatgcagagtagtagtagttttgattgaattcatcatttttttttttggtcagcaagattgaattcatcatgatgtgattactaagtgaaattgttgttatctaagataataatattgaaatgaatggaagtacttgtattgtaaaattatataaattgacttttgactttatagtgtactgatatacttattgtgaagtgtaagatattattgtggttgtactgaagctgctaagtgaactaattcaactaatttgatcattgggatttgtttgaatttgtcaggctgccactgctgaagaagatgatgatgatcttgatctctttggtgatgagacagaggaggataagaaggcagcagaggaaagggaggctgctaagaagcctgccaagaaaaaagagagtacgatttctttaatgtctcctgactgtaaattgtaattcgtggtccatgaaacatttctcaattcccagaaatataatattgatagaagccataattgaatttgtctaatcctcctaaaattgcatagttatttggggaaagtaggaatgtcttgttatatggtagagtaataggttgaaatttatgatgactggtcagacactcacgtggactattttcttatcgctagatcttattttttttgttgaaagcctttgacactatgacttaattgacatttataggtggcaagtcttccgtccttcttgatgttaagccttgggacgatgagaccgacatgaagaagctggaagaggttgtccgcagtattgagatgcctggtttattgtggggagcatgtatgaaattttcttaaacttttctcttgcatatttggtgcatttaacttctttcaaaattatattttatctaaaatgtttgtttctattggtacagccaaactggttccggtgggatatggtatcaagaagttgcagatcatgatgactattgttgatgaccttgtatctgtggacactctcgttgaggaacgcttgacagttgagccatgcaacgagtatatccagagctgtgacattgttgcattcaacaaaatttaagttttcttgttgacttttgagtttggccattttcaagaggctgatcagtctactactctttcatcgttcatgtttggtctgtttcaatggtggttttgttggaaaaattgtgagaagtaaaaagatatatagatatattaagtatccatgttaagatgtaactttgaatattatttcttgaattagatttatgggattaagataactgaacgatgtgcttccatttaaattttgataaggttctcaaaacctgtcaatttcattgaatgtgcttcagggtgtatagaataaaaccagtttggtttttgacttattataataattatatcattttcttttcaagctatttattggtgcttaggggttctcgaaaccaaccaagaatatgccatcgtttgagtgcatgccttcaccaacgccaattttgctgaccttagcttcatcagcaccaccaaacaatcattattgccaccaccgcttacaacaatacccaaacaaattttgatttgattccaagaaatatcatacatattgttgtagtaaatactaataaattaagggatcatttgtgtatttcaccaaatacaatttccttcaaatttttttgtcatgttagcctcgattgttttgactatatttaatggaacgattgctttgcctgttaaaacccaattcagccaattagtttcaactttcaacattcacataacttctgcagttacaaaacactgatctttaccaaattctttgcgtgtcttctcattatcacctttgttttgtaaagttcatttgttcggatcggaactttatttgatttagtatttaataattggaattttgatgtttgaaaaggtgaaagatgatatcgaccctccataatttcagaaaatgaatggtacttgactaaattaccctttattgatgttcttattcagcaaaaaattattattattttgtcagcataaaaatatattatttaacttagtggatgtattactattaagagtcaaaaatattttttttaaaaacaatatgttcctttttaataacaataatttttcttctttacaatgactaattgtagaatagaaattaaattcagtaagaagctctactttcaaacaattgctcaacttcaaataagaaaatatcaaaatatagtattggttataattctttgcaagacattaaattgtcctaaagcactatcttacatttgggggcctgtgataactaaatataattgctctcatttgtttggaacaagaagttgcctcgactattaacaaaccacgaaaacttttattttcttgatgcatcaggattcagaacgaagtagcattacataatacatagtaagtaagggtgtattatgaaacataacactatttgatcataataaaaagaatatttttacctatcaattttttcattcaaatctataaaatattaaaaacaatttgtctactaacattagaatttagaaatgcacattgaaaaagtagttaagataaaaaaaatgctttaattgcgggtcaaacaaatgtccaaatcagaagtctttagtcacatttatttatgagtgacataaagttagttggaaaacttaaacaattgggactaatgcaattatagggcaccatcaccttgtcgtgctatataatatatacatatatccatggtccttcctatgctcgtggatccattcataattgatcttatcggtgacttatatcatctatgatctgtctctcgtacatggcaacacaaattttaaattaatttttaaatatttttaataaaaatagttaaatttaagtgaattgtcagtaaaatatatatttttaaagaaaagagtaaactctcgtttttaatcattaagattataaactaacgggagttcaatttaatggaacgtgctagtctcatataacctacagttaaggtttgatatcaaattgcgtctcaaataagaatatttttaaaagagaatatctaagagaaattatataaaaaattaagattaaagtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttactgttattttatattaaaaaactgaagaaaaacattaatttttaatgttaagaattagtaaagaaaaaaattgaaatgttaaagactaaaatatataaaaaggtaatttcaaaagacgattgtgtcaaaaaggaataaaggaaacgtgccttttagcatgtagcatgggcaaagtagctgttgatgatctaactcgatatattattggcaatagcaagtaatatctgtttgttttatattaaatacatagtttaaattcattttttatttctataatattttgtgagcgtgtaattttagttccaacacaaatttaattacacatttaatctttacgattttcaaaattgaataattgtaatctaccactaatctgcattcaaaattaaatgataaatattaatatgaccgtgataaataacacgtgtgattaacttatttacattaaaaaaataataatatggaaaataaaatataaaatttgctttaatatattttaaaaattatttctttcaaataattatattttcaattttcaaaatttataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttaatttggccattggagtatatgggtattgattgattgaaaccccatatgaaaataaattgtgctttattgacaagttctttgttttcttaattttcaattgggggttagttatgccttctctctactgttactgtctccgaggttatgattcatgataagttatctttgcatcttgcatgaattttgttattcctttattcacctttgataaaaaaaaaaattaatccttttaggaaaacttgatttcatttcaatttgtttattatgatgaatatacagagtatttccccctctattgttactgttggacctgttctttgctgtcctgatggccggatatatggctttttatctgagtaaattgttgtgttgggtaattttgcactgatttctagcatctggtttaatgggttcattcaattgatgatttgcactttgtgatctggttgtgaaattaagggtgcttgcaacacaatttctattggttaaagtttgttgaaattcacaggattattagtgaaagtcattacatggaaggtgagaccagcatcattttgtgagcccaataaatttcagttgattgtaaaaaaaatgtgtcaaaggatgggttgctatcatttccctcatcaaatttgttctagtgtttcataatttgatccaaagatgacactgtagcaacagcttctctgatcatggtagtcttgactcttgacttgtcctggtccaaatttaagcaataggatggtttaatgtgcttttatgtatatacatagccatcgctcacttttggtgagataacctgttcctgtgtgttactaagttggtggtggtttaggatatacatattgatactagcataaccaattggcatattgaatcttcatgtctttttgattaattaattcttttttagttctgattatgtgtgagtatatttgacaaaaaatgaaagttgaattttggtgcagattttacaaattaaattttgttaaaaagaaagatgtcaagtggagcaacacactggtgttatgcatgcagacagccaattgtgcttgatgggagagatcctgtttgcccttactgtgatggaggatttgtacaagaacttgatgagttgcgaggaattgcacccaaccataaccataccttttcgtcacagtcaggagactttcatcaaatgcctgacattttcgatgctatacatgcttttatggggcagagaggttctgaccagagattcgggcttatggatgccgttgataatttcatgaggcatagaatggccggaagaaactcaaactttgatgttagagggaggtctggttctgtcccagttcctgaacagagttggggtgtttttagttccggtccttatttaatatttcatggtcaagttcccggattcaccttggctgctggcaacccaagaggtggtcctaggcgtgttgattttggtgactactttatgggtcctggactggaagaacttattgagcaacttaccatgaatgatcagcatggtccagccccagctgcacgatcttcaattgatgcaatgcctactattaggataacacaggcgcatcttcgctcggattcacactgtccagtttgtaaagaaaaatttgaattgggcactgaagccagagagatgccatgcaaccacatttaccattctgactgtattgttccttggttggttcagcataactcatgtcctgtttgccgtgttgagctgccacctcaaggacaggctagttcccgtggtactcgaagttggggaggaaggaatgccagcaacagcagcagcagtggcagcaatgatatctccaggggcagagagaacagccatcagaaccatggaaggagaaatccattatcatttttgtggccattccgctcgtctaactctaacaataatcattattctgagactgggggaagcagctcttcaaccactcctgaccagaataatggaacaagttatagcggttggccctttgatcgctaaaagtatcctttcttctcctggataagtacaatttgctgtctaataatgcttgtaatttaaaatgccaaggaaagagtttattagtattgtattttaaacttgagctcatgtaaggaagatagaagtttcttaaaatctttgtacatgaaattgcctggtttgttgaatctctttgaaactttaatgccacacctgccattattcaatttgattgtatcttgctgcttatttggtttgtttggttcctttggggtcttggcagcaagcacaatatgctaaagactaaagagagtgaatttggtttgttagatgaatcttttagccagtgaatgtgaattgccagatcacagattaaggttgcttcctgagataactgcatcatcaagcttatggagtgcactcttgagaatggtgtcaagctaattctctttctgtttgttagcatggttctttcaaaactcattagtgaggtctagcaatggaaacctttaggaaatactttggtggagttgccaaaacaacttggcattttaataacttgggttgaattatggccaaaatactatgggaaatttgtaggaattttgccgtaacaatttaatgtatacatgtcaatgcatgtgttagtcattttggtttatctcaaacaaaagttgagaaaaagtaagattttacatattcaaagattgcacattgcatccattgacattattctgatgtatatccaaattaatcatagtcaaaaaatttatattagaatgcgtctcacaatggctatagtcataaatacacaagcacttatgttgtacgttttaaagtcctagtttgctaacccacccatcaacagcctaaataagaatttgctatcatcctttgtgtctaagttggcaggataaagagattcaaaaccctcgatagctgatagtttcaaagcataaattaatggaaaaattagtgtaaattgatacaattatctattttgaaaatgtaaatatgtagtttcatcttaagacatcttattgctgtgagaacttcgacttacacgatgtaatatgtattggaattttattttagtaatgaaacacggagatagtcactggattgagtctatatatggaacactaggaatgtagcctagagtcctagactcagatgaatgtgtggtttcttgcgtccaaataatcatagataaatgataacgatccacaagaaaacatatcacatagtgagggccaacttggcaacttctaatgattcatatttatttatttatttatttttatttttaacttactttatttgactttttcttttagataaaagttaaaattattgtagttaactttctttatacatcatatatcaaattttaaattttaaaataaaataaagtaataagaatccaaaagtatttaattgacgttacaaaacttaaacttgagaaaattatcttttatgaaaaaaataaaataaagaaaagcaaaaagagagaagatcattcatttcttgtttttagtttacataacaataacatgatggattgtgatttttatttgtgttaataacaataaaaattaattttgaaaaaatcaaatataattaacaaaaaaaatattcaacataaatataagttaacaaaagatattttgggtaattaaggttatagtcaactaaaagaaaatgtagataaatagatgagtgttcaagcttatttccaaatcatatgaagtgtcactatgagctagtaaacatacaagttgaactattgaaacattacattattttcaaaatttaacttatttatctgaagattttttatttttttaaataaaataatttttctcaagtttattttttgtaaatatactcatttggagagtatgaataattatctttctaaacgaaattaaagtgttaataaccccgtatctttgtcatgatcgtgcttttgtgattttgtcatgtacacagaaaaacaaaaggtgggaccctgttggcatgcatgcattaattaccatgcctaggagtcacaagcaacataattctctggcaccaaaggtttgtatatctgtcacaaaaaatacaaacaacatgaagggtcgcatatcaagaggtactacatacatacatatatatatatatatatatatatattctttttctttttctgatcattgttctttcgtactgtttaaacaattaaaataataaaatatttattgtgaaagttataaaaattattacaaataatataatcttatatatttcaataaaaaaaatgctttttttagttatttagtcagtgttgtaagaatattgattgatatttgtctttttttttatatatcaatggttatttttgcattgaaaaatattttttggacaatcttaagttatctataacttgagagagagataaatgattaatttaattgatgatatattataataaaaaaagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataaattttccacacactgcgcaatacgcatgttaacaagttggatcgctactaattgagttttaaaatcactggctatttttaaattttcctattgacatttaggaaagaaggttggactttgagatgacaagagaaataattactcttcgatccacgttttcttcatttattttcatgttaatttcaaatgaattcacaaaagattattttcatgttataaattagaatatataatttgaatatgcccttttaatattctctcttccttagatgtgttttcacacattattttctgcaactagctaaccattcgataaagtagatattctcatatcactggttaattgtgtcaatgtcaaccgttagatttggctactctcatatattgctatacaatgaagctggggcagacttaacagaggaaggacatgcaggatccaatcaaaccacactactttttatcatatgagattattgggatatttgtagtgggctatggaaaattattggaggcaaaatggacacttcacatgctctactctacacaacccttgtattcttttataataaggaaattagagagggaaaaaaaagttaaaggattcacctagcaaacaaaattgagccaactgtgatgctgccaacttggtctaaactttatgagtagttatcattggaagccaacacctagctagccgcaagtgcataaagaaaaaccaagatattttgtcacattaatttgtgtctttatttattgttgttattcttcttcattttgagttgtgattgtgtgtttgatctctaatcaatttggcagctcaggctcactaccacaagttattgcatccatattggggtggaatttcagaccaaaatccaaatgattttgatagtgaaacgatccaaagaatggaactaaaagtagcaagggagtgacggtaagattttaatcccacttgttgatgcttacaagataaggtaaaagtgaatgattcaatgaacgtagtttgaaggtctaaaggaacaaaatggaataacatgtacacgacctttgtctccaaagtttcccctttgcataataaaatatactaaggtctgtttgcataagtttcttcataaaaatgaaataagtgtatctcaagcaagctaaaacaagcatatgtataagataaaatcaacatttttagagaatttaaatgattctaaataagttgattctaacttatacataaattaattttatcttatgaaaaagtttattttatttttattatttttttcttctactaaatttatctaaataaagccttaaattcaataataactgagaacagaaacataaaatgtggaaaaaaaatagccgtatgactttttcaaaggtgatgcaatctctcaattaattcagaaggaactaggcttcttgaacatccaagcagtagtaaaaggttatcctccctcctggaactaattaattgaggtggcttcaccaatgaagatgaatttgagttcctatcagaccaggacattgaagcagaaacaacttcaaaaagttacaacactgtcaatgacaaaaacttgctatgtcaaaacttaaaactacttttcaagaaacaactatgacttgcctatgtttgttgtattaaagattaacataacatgatcatgaaaaaaatgagcaatcaacacatgcaaacatgcaaggctatgcatattagctatacctccatacgttcagcaaagtccagggccttcaaaattatttctgggaccaacaatgagagtataagtggtgaagtcagcgtgtatagcagaggcctattgggagatcaagcactgaaaatcaacattatgaaacaataaagaagtagaagacttggatttcatttcataattaaaatttacaaagaagtagaatcgtgccaattcctagcatttcaactgtgcaatatacttgtttggtgaagctgaatacaaaaaggtacaactcacagtaaatcataagttgattgtatcaaatttcagtattatcttttaatcgaaagataagaaagaaaatgaaaaatctaataaaggacatgtcttagtatttccatgaagagtgatctgtgataaacattgttgaaatctagtaactaacatgatactcatatatttaatgttgtaatacacaaaatggtttccataaacaggttcatattataccatataagattgcaatatatatctagttatttacatgcatgtcacaaatgaaacaactttacaagagccagctaacccagttggaaggaagcaaaaaccatttaaaagttattcaaagtgacagtacccatgttaaattaaaaaaattaacatatgctcccgtgggaacacacacatgcagatcaggcagaaacacaaaacattggtagtagaagaaaaaaaatataaagagcaaaaaatggcgcaacttggtgcctgcaaccagtattaacagaaggaaaaaaagaatatactgacagatgatgataattataaacggacagacactaaaatgaataaaaaattataagaaccaaaataaaaaataaaattttagaaactaaaaagtatatatatttaaatattatattgataagctacaagtttataagttaaatattctaattccaataagataaaattcctaaataacaaaacaatatcaaaccaaattttcctcacaaaattaaaatgtgcacggattaagatagtggttagacatcctgtgtttgacaagttgtggaaataatatatcaatatcgtccacacactcgtattgtacagaagaacattgtgtatcatattcatggttatggtctctcttcttgctcgtaatgcattaaaaaattaaatgaccattgaaaaggtttaagtggatccatttcgattaaaaaaactatttgagtggggtcagtagaatttggacagtgggagaaatgggatttcgtcacaagtaaaaaccatgcttgcgttaaaagtctgttcaaactgcatgtaattcgtgccgacgcaatttcgtccattaaccacgatgtataattggataaccgaagcacttaaccaattgtcaacgatgatattcactgcatttaattcaaccttccttgggtgactcatcaatttttactgagttgacatgatttaatttttttaatctcaaattaaaaataaaattatttctaaaatatcattattcattaaattttgttatcataaataaataaaaatcattaagaaattaaaatcaaatgaaagatatttttaaataataatattaaataagataaaattaattaaatttatttatatttaaattcaacatacaagtttaatttttttatatatgaatccaaagtgagcaataacttgaactagatcccttaacacgggtttatttaaacttggttagcttaaatcggtatccacttcagaaattaattacccattccttattcctacactttatttattattcaacgcaagttgttcattaacgcgttaaacccataagttctactaatataaacataaatttgcggcatattttgtgttttgtgtgatgagtggcgggttagaacttagaatgtataatttgcatgttccacccactgaaagcttaccaccaacaatcaactgtagaatcataagaaccaacatcaaatcaaacatattctgatgtctttcattttattcattcaactttctcccctcattttacagagaaggagaagaaacaaactgtctcggtaaactaaaaagatcattcccttcaaaaggagaattccaccccatggaaccagcagcagatgtctcagcagaagctactccaccatcttgcaatccaggcatgggagcattcatgctcccatttgagggcactggtctcattgatgattgagcaacaactcctgaagcatttgagtcatacatctgagcactactgctccttgaaaacggtgaaaatcctagccataaaccgttggaccttggtgaagctaaacttctgtccaaggaccagtctatgttggtataatcaaactgcatggtcccaccagtgctccagtctactggagaagaagcccctgatgggcctgctgatcctagaccggaaaagagtcctagagaagtagcagcagcaagcggtggaattgcacctgttctattccaaatgctattcccttggtgatctactgaattgctgctgccaccaacaaactgttgttgttgaggttgatactgaagttggtggtacatttgattggaattgagatagtttggactgaggcttctagtgctaggagcatgagatatgaagtcattattagatctgacagcatctgaactgttagatggataccaactagcagcaatttcaggaggtgatgagctcatgcttgtggctggaacttgctttgcatttacagtctggggccgctgcatcatgattaatggttccctggctactccatgttgaaggttcttaaaatcacctccagcaggcatatattgtgcttcggacttagcaggtgggggtgacatttgcaacggtgatgccagtgaataagaaacggaaggattagatcctgcacttggccaccttttatcagctggtacagtagcctgttggggctttgcccattcagacttaggttggattctctttagaggttgcatatttctattactagaatctgaagatactccaatcgtcaatgcagcctttgtatagttaaaatccttgtcatcttttttgggttgatttggtaaaggaacaggttttgtttgtggcattgagctctgacttgcaactcttgactgcttaacattgttaataataggaggatcgccggtttcctctggttttggtggagcagatggtggatcaagtttcaagtctctcaaggtctttgcagccctatcaagatcaccctcacagttaacaatcgctctttcgacctcctgttttgagcaatcatacctggttaccatatctgcaatccgagcaagctcacctgatatgtcaattttcaaattgcccctatttatgtttgtatccttcttaacgtctgcatcttcaccaccttcaaacaaccacgctactgattcctccaccctaccttcatttaatattagtgccattgttgccctttcatgagaaaatcccattgccacaagctgttgagaaagtgcctcaagtttccttgacataagataaccagtacacctctcatgcaactcctgtgctcgcctttccttctgccgttgatgttttctctcattcttctggcggattttctctcgcttgtcattatcagctcctggtactgattccggtcgaacagaaacattagaacttttctccttatgttcttcggactcaccagaccaactaccattgttagaaacagaatcatactcaacaccagcaaccactgagctgacaggatgttcatctgtctcatctatgttctgaaaacgaccattcgaatgtattggtgaggtaggtgttggtgacatgtccagagtatggaatgttcctaataaggggttatatgcactggctggcacaccagctgctgcattaccagatcctgtaggctttgcagaagccttctgagcttccttgcaaggcttcctgtctttagacttggatcgggatgcaggagacatccttaagagtcaatggccctgtaacattaaaagaaaacaagttatagtacattgcattttaattaccaaatcaagacaggattacatgcatcacaaacctattgaccaaataatattctgttcaatcgccaccccccctcccccccacacacacacaaaaaaaaaaaaaaaaaaaaaaannnnnnnnnnnnnnnnnnnnnnnnnnnnnnnnnnnnnnnnnnnnnnnnnnnggacaaatgaacaaaggcaaaaagaaagtgaacaagccaaaaaacaagtacatgttaaaataattaaacagaaaccaaacagtttatcttccccctataaagaagttttaataaaaatcattgaggaatataggaagaggggaaggatttcatgtccatacactttaatacattttaaaaagagaatttaatcacagaggaacttttttaccaatgatgtctaaacttcatttatatgtgcggaaccagaaatttatataattaaacaaccaatctgacagcaaaaagcaagatccctctcggaatggcacagtatcaaaattgaaaatatttcagttgaatttaccagaagaatgcacaacacttattaaaaagacaattgagagtgaaagtatcatacagtccagtatcacctttcacagaggttcagcgattcaatggcgccgatattttcaaacaatcaaccgtaagacaaaaataaaacaccattccatgttctccaatcctccaccattccacttatacattaatcaacacagtaaataaaaggaaaaaaaaaaaaaaggaagttgattttcatattcctcaaaggccgtgacatgattgatgactcccccaaattttcacacgatcaccccacccctaacaaaaatccaaattcttgtgaaccaaccatgaccccacaatcccccataaaactgatatgtgatatgtctatccaaacatccaaaaaattccactttctggcaaaaaaaatattccccaatggccactcaacacaaaaaatctataatcacacacatcctattcaaaattatatatatatatatatatatatatatatatataaacgcaatcaaggtcaaaattacaaggatcagcacactattccctctagaggatccgtgatatgcatgcttccccaatccaaagagacccgaaatccccaaataccacaaaaggcaaaaatgcggaattcgaattaccgaattccgcgattgcacaaaacgcgaaaccaaacacgcagtttcttagtccccaacacaacaacaaagaggcgtattaccgaattccgcgagagaggatcatagctgcggtttgagattgaaagaaagagagagaaaaatcgaaaaatgggaacacgaagaagaaccaacctggggtttcggaaatgggagcgttgatgacgatgatggcgacggaaggatcgctgttgaatgccgaaatcgttggagagagagagagagagagagagagagagagagagaaagagagataggtttttcgaggctcaaactgagtttggcagaattagggttttgaagaaacagagatcttataaaagataaaaacaacgacattaatttttataaaaaaaatcaacttatagagtaaaatagttaattttaattgttcatataagaaaattaatcaatctataaatgtttttaagaattttttattaaaaatataaaactttttttttaataaagaaaacctgtatccaaatagactttattattagtagtatttatatattgacttttaaggaaactaaactaagagctatgtgcaaatttaccgaattcaaaagtttcaaactgagccaatttgcaataaaaaaacaggagcaactttttcctattcaaaattattttgccttagactacacatataagattctattattgtatatatattggatatacgcaaaaacaaaattagaggcataagaagtaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttatgctatttttttgcagtgagattaagggggaagatcaaacaataatagattgtaatgtattctgaatatgcttaggaaggtaaagagaaaataattaaatttattaatcacgtaatataaaatcaaattaatatttttcaaattttataagaatccaaaatatattttgtctttcttttttaatttttgtatttgatattgttattttaaaaaataaaattataattataataaaaaacacataataattaataagttaatctataaatttaagtactcattaattacacatagtaatttataaagtatatatcatgactcactttttaataaataatactgactaatttataatgtcaaactaattaacacaatttattaaataaataaaaattaaaactaaaatagaaagtgttcaaaattttcattcttattataccaaagataactaagaaaaagataaatatataaaaatatagtaaataatatcttgtcctaattggtttatgtttgtattttggttaactcatgaaataaacagtattggaaaaaaatttatcttatgtatgattttgattcagagcaagatgaagatgagactattttgtattaatatcatgtttaaaaaaatttgtgataaaaaataaaaatattattataatatgactgtagatttgtagtatgaatgaatgaaataatgaataataactcatcatctatatttacgaggaaggaagaaattcggttttggctttggtgtaagttggacttggaggctcctaagtgagcgctttcgtgataggggaagacacgcacttcaaactcacgacaaaataaaaattaaaactttcccactttgtgcttcgtcttcttcaacgttaatcttgttttcttcccctttataaaaaccaaagtggggtttcgccttcttctccaaccgttttcttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatgaggaagaagctagatactcgtttccctgcggtaaagtttctctttccctttgcttttgttttcttttttcatgtagaaaatattgttccttgttgttttgcattctattcattgtgagttgtttatgtttgctattttttttgtgtcattgggtttgttgttttttgttttccttgcgtaaattgatgtttctgactaacatgggagatgggtttctcttggttttggaatctctgatagttatgtttgtgcaaacgtgctttgtattaacatgtgaggctttggaattgttgttgcgttaaatttttttgccatgaattgttgactttgttaatgaattagatgttaaagttaatgtttttctggtcaatattgttataggcccataggatgttgttaatttggatgaaataagttttctttctgaaagagaaagaaggatggggagcctgctgttgaattttaatgtagtgcaacatactttaatcagaaaggaaacaaatgttttgaagttgtgattggcgcatatcttaaatctttttttattatgtgtatgtcttaacttggagattttgttggtataatttcatttttcgtttttatgtctacgtagtatggaaatagtagttgtcttgtaaagcatccgcatgctttggtttggctgtggaatatcaattaccaattttggaatgtaaaaccttataggtggtttggcattgctttaggtcaggctttgtgtattgtaagctaggacagcatgttgtgtgtagtactgtggtatggtgtgatatattccccttctaactttttctaaatttggtattttgtatcttttttaaaaattccctgaatttggtccctctcaaacaatggtatttttgcggtgtaggttggccactacctgtcctgtagatgtattttagaaatgatactttagatagatgaggacgaaccctgacataacagtaaagttgagctttggtgactttgttggtcatgagttcaaatctggaaaagcctcttttcatatgcaagggtaagattgcgtacaatatccttcccccatatcttcgcatagcaaagagcctctgggaaaatggagtacgtgatttttttttatactttagatagatgtaaagttgagcaaatttatttgtaagccatttggtttgcaaaattacttccaattctggattttattctttgaccttctgagaagggattgtttattcctttgttaaaactactgcttccaagtatttccatactataatcctggaggatagcatatcacacgtgctcaaacagaataatacaacaacaaaaactcttttcccactaggtgggctggaatatatggaccaaacaatgccaccatgtcctattataaatcatgtccataggttaatcatttaaatacaaatatagtttttgttggtctctctctatctctaactatgggactacccatcatctgttgtactttattcagattctatagtttttctccacacatacctaagccttgttcatgtgggaaatagacacaagggtcttctgtcgcacaccttgtattcttacacttttgaccccattgtacatgtatttgattgcttgaatatagacaatatacctttctgtctccacagccttgcacaatacacgcatatcttttatacttttatttttaggaggagagtgagtagtggaatttgagcatagattacatctggtggagtaggacaaacactcagttttttcctttaacttttagttgaaaatttatttctttcttcatttattgccgtggaatttccttaattgcatcaaattagaatcctcttctgccaacatgatttagttttagacattttaagtaatgattgagtaatcttattgaattgattattggcaggctaggattaagaaaattatgcaagctgacgaggatgtagggaagattgcaatggcagtgcctcttctagtttgtaagtagcttttctctttcatgcatattcttgggtgttttcttcttctcttgaaaagtgatttttttatatttttttattgtgctcttgggagtttctatgaattatttctgatttatgattatttatgtttatgtattgcagctaaagcactagagctgtttctgcaagatttgtgtgatcgaacatatgagataactttgaggagggggcaaagactatgaatgcttttcatttgtaagtgaagtttctattattttcttggttcaaatttgtgtctatgtcaagtctgttcaaggtggtcacaaggctgcaggtttctttcttttggagggcggttattactatgtacttataagaacatcagatctgcaattctaatgataatgtgctcggtgtcaaacaatttccctcttgttccttctatttatcacatgcacaaacatgattagacatgtaaatgacatctgcagaagcaaatgttgggatggtcggtcttgcttttggaacatgtgctgtttgttctagtatttaccttcactttccagtttctaaaatgtctgagttacttgcatccttgcctttgcagaaaacagtgtgtgcagacttttaatgtctttgattttctgaaatttattgtcagcaaggttcctgatttaggctgttctgttgcaactgatgatgaccatgctgtcactaagaggaggtttgtgctctagttaatactcttgttacttggaacaagttttctgtatgctgaactttgtttactttatattaggaaagttgccggagatgatgataatgacagcgacgaggagctcaagagaaaaaagaaggtaatttatcaactgtattcaattacttcatcagtggttagcttaaatttttcttgtgtgattaaaccttttgctgagtaattatctcttgtccatgcacactgggaaccttttgctggatacaaaaaaatttacttcagtcaatagggaaactcactagtggcttgtgaatgcaagtacgtctaaatgtctaatagtctgtgaggctaggccccacttcaacttaaagcttactacacataggaccaaaactgtctggttttctgaaaacttttgctgaaaactatagaattggcactaaagaacctggcagctgtttaatattaaatattatctgaattatggaactttgtttttttttttttttttttttcatgatttgcacagccagagccgggtaggggcagagctaggggttgtggccgtggaattagaaatgtagatcaaaagatgagttcacatgctaagtgtgaagatgattctgatgcattgaagcagaatgacactcaaagcaatgaaagcatggaaaatgtgccggaacctgaagaagttaagcagagttttccagtaagcaaaccggctgaagtgtccattcgaaattttgacttaaatttggacccagatgaggatatggattcattagacacaccaacttctgttccaactagttcatctgcaaaatcagtgtcagaagagaagcctgaggaataccctggaaggtccttgtctgaaatggaaaaaatgaccattgatcccattcaactagccaacataaatggaaggattgatgaagatgaagaggattatgatgaaatgtagatgaacctgtgttggtttattcattacttctcatacaggcccgtcattagaatgttcttatgtggaattagagtagattttataggagcagtagatagatacttactccttagtagtttaggaagattaggagggatagggtattgaatactctccttataacttatgttttaggttaaaagtggagatatagattgttccaattagaaatagccatttgccagtatagttatgacttatgagaaattttaatctcatgtaggcattgcttatggtaggcactacatttataattatttccattatttttctaacatgatattattattttttattatagaatatacttatttgatttttaatatataagcaccactaattgctgctctttaaaactaatctcgcctcaaactagtttgtttaaatttaaaataagtaatcttaaaataaatattttttaaataagcacttatttaataaacaaataatgttgatcaaaataagtagaaagctgttttttaagcataaacacaatttagacaactacactaaaaaatagaaaattatttattttatcaaaataaatatttttttcaccaaataaatttaagcatacttatcaaagaacatcacttgagttacaagcgggagttgggccaattagtacacgtcactatgtcagacaattataaagaattatttgtataattaactacccaatgtgggacttgcattgcctaccatgaggtgaacatgaggtgaacgttatctaaggtggaacataaagaatgttctaatggttttgaatctacttggaatactaataagaaagacgtgaaactaaaattccaaagtacagttaacttgatcctagctctagatccacatgcctccgtccctgattgaagatatctgaagtttatatttaatatcgataagttctaggaaacacagaatagttgggattcaatctcagacattggaataactataatttcttattaaaatgtcgatctaaatggttcttaacataataacagtggttgtgacatatacttgctcccttcaccaaccacagggaaagaagctgcaaagctttggcgtaagatatgcagttttcggaaaaggcattacagtctcaaattaacttgagcccatagttttttaaacaattccagacccgctcgagcaccttcattgctgtggtcctctttcatgtctagcaacaagcatagtcgttgaatatccttataaaccattttgtgaagcagattctgagaggacaaaatttgcaccattttgttgtggccatataaaacagccaagcgaactggaagcatcccatcttagtttggtatcagcctagaacgattggatctgaaaattctaatgataatgtgctcagtctcattaaatttccctcttttgtcttctatttttcacatgcacaaacatgattatacgtgtaaatgacatctacagaagaaaattaaatgttgggatggtcttgcttttggaacatatgttgtttgttctggtgtttaccttcactttcagtttctaaaatgtctgtgttacttgcatccttgcctttgcagaaaacagtgagggcagacttttaatgtcttcgattttctaaaagatattgtcagcagggtttctgatttaggtggttctgttgcaactcgtgatgaccatactgtttctaggaggtttgtgctatgattagtactcatgttacttggaacatgttttctgttggtgaattttgtttattttatattaggaaagatgatgataatgacagccacgaggagcccaagagaaataacaaggtaatatgtcaattacttctcagtagttagcttaaatttttcttgtgtgattaaaccttctgctgagtaattatctcttgtctatgcagactgtgaatctttcgctggttaccaaagaatttacttcagtcattagggaaattcacaagttgcttcactgacttgcgaatacagttgggaatgttctttatacaaaagttattaggcttaaatgtatagtaaggggttcaagagacttaggtttagatttcttaatctcctatataataatcatatttgctctagaaaaatatacgagttgtcagcatctacctgaataacatttatcattcgtagtttattgaggaggtgagagaggacttaccaaagacaaagcaagaataatcttataacattcatatgtactatgtcctatacgttttctcttattctatggaatccttcaaattcaagtacatttaatagtctgtaaaccttattatacaaagaaccaaaactatctgattttcttaaaacttttggtgaaaactgtggttgtaattgagcaaactatgcactatagaatcagcactagcacataatgtggaaattctagctgagagatgcaacattctaaagaacctcgcagcagcttgatgttaaatattatctgaataatgaaatgttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaggattatgataagaaatgtagatgaacctgttttggtttataaagttctaattgagaattagagtagtagtattagacaaatccttagtcgttaggaagattaggagggacaggacattgaaaactttagtccttacaaactttgttttaggataaagtggagatattgattgttccaattagaaatagccacggtattgttatttgagaaattttaatataggttatagtaggcactacattcagatccttaaacttagggattttgattttgttttagctttgattgtggcnnnnnnnnnnttttttttcatgatttacacagagcctgaacgttgcagtggcagcggaaggaggtatcaatgtcagaagagaagcatgaggaataccctgaatggtccttgtctgatatggaaaaaatgaagattgatcccattcaactagctaattaacttaaatggaaggattgatgaagatgaagatgaagaggattatgataagaaatgtagatgaacctgttttggtttataaagttctaattgagaattagagtagtagtattagacaaatccttagtcgttaggaagattaggagggacaggacattgaannnnnnnnnnnnnnnnnnnnnnnnnnnnnnnnnnnnnnnnnnnnnnnnnnnnnnnnnnnnnnnnnnnnnnnnnnnnnnnttgattgttccaattagaaatagccacggtattgttatttgagaaattttaatataggttatagtaggcactacattcagatccttaaacttagggattttgattttgttttagctttgattgtggcattgtgttgtgtatgtaagtctgttattgtatcacataacgtgtcctctctagtacaatttgagagcaaatctgaggatcaaacccactgatccgacaacatgatttgcactaataagatgaaaataagagggatagaaataaaaatttaatgtatatgcactaataatataaaacaattttaggattttacaaattatcatttaaacataaattattattttaaaaatcaacaaatttattatacacaatgaattgtgattaaatgacgatataaatattttacactctcaatacataactttgctcaagaaatatacacaaaatacgatgaaaataatgtattattgacatgaatagaaataacaagaaaaaaacgtagatttttatttgtttgaataaataagagagtataaaacaaaaatatcttcattgcaaaaatgttcatacaaataaaaaataaaatttaatttgaaaaaactgaactttttatttcattatttctcaacataaaaatattttattataaaacaattatttgattttttttaaaatttaaacataagtaaaagtaaaagaacactgctaaccatttctccctccatttcaagtcttagtgagaaatatggtttggttaggactcataatttcatttctcattttctaacacattcaatcaagaatatttttttatctctttatttctcttcattttaattttatatttatttataaatttcttgtatatagtaattattttcaaatggagtaggattaagtcttagtgaaagatgaatgtgtaataaaaaaagctttttctgtgttaagatttgatcccttcaccaaccacatagaaggaaggagaaaagctttgacgtgcgttgtgtagtatagtctcaaattaaagcgggaacaataagaaaggtaatatttcatgagatagaaaatgtagaataatctcaaatttaaacacaagcttcattgttccacaaacaaataataatacagtgtcttgaagttatgccaatgtctctaactctgtaataagttagtccagtttttcaaaacgataacatctagaccaccagagttcgtcgagaaagctaaaatgaaaaagaagaaacaaaagtattgggaacagccccattgaagccactgcataagaaacccacttggaagtgtgattaaatatcaaaaaggaggctgcagtgaaagccacaaccatagcagcaacggagataataagcaaccaacgcccaatagtcaagctgggatgtagtgatttcacaaattggcttcgtgcgaatcttgatgaagtgaaatttgacaagaatgagagtaaagacgcagaagaagtgaataatgcgactgcatttgtcaatatgaagacagtaaaccaggcattggtcttatcacctggaacagtcagagcagccgcaaatgctactgtagcaacaagtgttgacacaagcatgccagattcggccattcctttggctgcatccttaatttcttcggataacttcttgtgttcttcagaaaatatatcaattggtctcatgcccgctttgtttctcattatttttagttcaccaggaacattcgactccacgaactatatacaaatcaagagaatatgtaaatgatggtatccaaatgcataacttaattaatctttcaactatcacttaataactagaacaaattacagcaacacctcccaagatctagtgtaattacacaatttcctgaggtattagagtaaggtttgaggggatgttattgtaatgatttcaaacgtataaagaatgctagtgtaatttttcaaaaaaaattgttacaatatcaacaaatactacatacaatgatttctatttttaattaaaacttgttacttttaaagatttaaaatcagtctagttaacaaaatcctaaaattagtagaattttaaatttttaaaataagattgctagaactgatcgatcccatgcgagtgaataaagaatgtttgaataagaaaaactcagcaaattaattgaccttgaaccatttgatatctctttgcatttgaatgcttgctcttaaactggacaattcttcgaattcaccttgtggaagacgcgcagccaagtgtagaatgttgttacctccgtagtccactgcttgtactgattgctcttttaatcccaatggtataatattaaatattgtttcttgtcgacatagcacaaccaagtgcagtaggttccatccatttctgcggtccctataaggcactaatctattattattgttaataagcctcttcacagccccatcatctcctgattttattgcatcttcacgtttctgttccaatgcttcaacttgagtcaatacttttgtatatagccgactgtctgattcattggcaaacattaatgtgttattcgaataactcaacaaacatcaaataccattattacactcgatatagataattaaggactaattcttaattttttatatagaacaaaaatatatataactttctaaaatcaaaatcaaaatggaaatgatgtcaaataagatctaaattttagcttagatcacaaaaaaaaannnnnnnnnnttgattgttccaattagaaatagccacggtattgttatttgagaaattttaatataggttatagtaggcactacattcagatccttaaacttagggattttgattttgttttagctttgattgtggcgttgtgtatgtaagtctgttattgtatcacataacgtgtcctttctagtacaatttgagagcaaatctgaggagcaaactcactgatccgacgacatgatttgcacttgaaccttttttgttatcttgaatttgatgagaaatcagataaatggaaaaaaaaaataagagggatagaaataaaaatttaatgtatatgcactaataatataaaacaattttaggattttacaaattatcatttaatcataaattattattttaaaaatcaacaaatttattataaacaatgaattatgattggatgatagtagaaattttttacactctcaatatataactctgctcaagaaatatacacaaaataagatgaaataatgtattatttagatgaatagaaataacaaaaaaaaatgtaaatttttatttgtttgaataaataagagagtagaaaacaaaactctcttcattgcaaaaatgttcatacaaataaaaaatcaaatttaatttgaaaaaactgaactttttatttcattatttctcaacataaaaatattttattataaaacaattatttgattttttaaaatttaaacatatgtaaaagaacactgctaaccatttctccctccatttcacgtcttttattgagaaatatggtttgtttaggactcataatttcatttctcattttctaacacattcaatcaagaatatttttttatctctttatttctcttcattttaattttatatttattataattttgttgtagatagtaattcttttcaaatggagtaggattaagtctcagtgaaagatgaatgtgtaataaaaaaagctttttctgtgttatgatttgatcccttcaccaacaacatggaaggaaggggaaaagctttgacgtgcattatgctgtatagtctcaaattaaagcgggaacaataagaaaggtaatatttcatgagatagaaaatgtagaataatctcaaatttaaacacaagcttcattgttccacaaacaaataataatagtgtcttaaagttatgccaatgtctgtaactctgtaataagatagtccagttaggataaacgataatatctggaccacaagtgtttgtcgaaaaagttaaattgaaagagaagaaacagaagtattgggaaaactcccattgaagccactgcataagaaacccacttggaagattgatcaaatatcaaaaaggaagctgcattgaaagccacaaccatagcagcaacggagataataagtaaccaacgcccaaaagtcaagctgggatgcagtgatatcacaaattggctttgcgcgaatcttgatgaagtgaaatttgacaagaatgagagtaaagatgcagaagaagcgaataatgcgactgcatttgtcaatatgaagacaggaaaccacgcattgttcttatgacctggaacagtcagagcagccgcaaatgctactgtagcaacaagtgttgacacaagcatgccagattcggctattcctttggctgtatccttaatttcttgggataacttcttgtgttcttcagaaaatacatcaattggtgtcttgcccatgttgtttctcattgttgttagtttccgaggaacattcgactccacgaactatttacaaatcaagagtatatgtaaatgatggtatccaaatgcataacttaattttcaattatcacttaataactagagcaaatttcagcaatacctcctaaaatttagtgtaattacacaaatatattctcaggtataagcttaaaatttgaagaaatgttagtgtaatattttctacatataagaaatattagtgtaatttttcaaacttaaaaggagttggtataagaaaataaaaaagtggaattacatataactacacgaaacttgagggtaatttgctctaataactattagatattaaatttgtaagaaatacaatttcaaagttaagatattttaaaaataaatcttacgggtgatatttgttgttacaaatgcacttctataatttttaattaaatttttttatcgatctatagattgcctgtttaactattatgctaaagacaatggataacaaattttaaaaaattgttacaataatcaacaaatactacatacaatgatttttatttttaattaaaatttgttacttttaaagatttaaaatcagtctagttaacaaaatcctaaaatttgtggaattttaaaattttaaaataagattgctagaactgatggatcccatgcgagtgaataaagaatggttgaataagaaaaactaagcaaattaattgaccttgaaccatgcgagctctctttgcatttgaatgcttgctcttaaactggacaaatcttcgaattcaactcgtggaagatgcgcagccaagtgtagaatgttgttaccttcattgtccaattctcgtacttgatgctctttaaatgtctctgttatactgttaaatattcttttttgtcgaaatagcacaacccagtgcagtaggttccgtccatttttggggtcctgaaattcacgattcatgtcaatcatcgtcttcacaacctcaacacatcctaattttactgcatgaaacagcactggcgaatcataaacaggtatcaactcctttaaaatcgaattacattccaattggttaacttgagtcaatatttttgtaaatagccgaccagcttctgattccttgtcctccatgtctagcaagcggtatatatatagtttattggtccaaccaatgtttaacatgaaatgaaacaaacaaaagttagattaaaattttattcttatatatatgaagcaccatttttatctctatttaaaaaattatatttttaatccgtacatgaaaaaaaattgtaagatatttttgcacatgtgactcatgggttggcaaacattaatttaatttgtgttattagaataactcaacaaacatcaaataccattattacactggatatataattaaggactaattcttaattttttatataaaacaaaaatatatataactttctaaaataagaatcaaaatggaaatgatgtcaaataagatctaaattttagcttagggcgcgcacacacacacaaaaaaaaaggccattttcaacttgtgaaagcttacctaaaatttctggaagctcttgcgccagcataatattcaatgtaaggtcttttccacttgcaatgaccagagtagttggatgtttttcaaataatttaattgccaaatctgttatatgcacaaattaaatagtacacggcaaggtaaaattccaactaaattgaaaaaccacgtacgagttcatatatatttccttttatatatatgaaatcaatgagaatatagctagataggacctgttcggttttaaaggatgatatcacagactttcagaaacctaataatcataattaattattcaacattttgaattatggtcaattattgtaccgaataacgttggaattatatatatatatatatatatatatatatatatatatatatatatcttatggtatctgatcggttcaatgggttcgtttcagtttgtaaaacatcataatatgtaaaggagaactagattaaaaaaaaaggagaaataaggttgtttaattagttttacacttaccaaacatgctgattctaatggtcatgaaaaacagtcgttcaatatccttgtaatccattttgtcaatcactttccgcgaggacaaaatgtccactattgatctgttgtaacgatattcagcagccaagtgaagtggaagcatcccatctgagtttggtattagcatgtcttctggcctcatacgcttaaccaactctttcacaatttcacccctgccttcacttactgctagatgaagagctgtgtctccccttgagttttgtattagcatgtcttctgccctcatacgcttaaccaactctttcacaatttcaggactgccttcccttgctgctagatgaagagctgtgtctccacttgagttttgtattagcatgtcttctggcctcatacgcttaaccaactctttcgcaatttcaagaccgccgtaactttgtgctgctagatgaagagctgtgtctccacttgagttttgtattagcatgtcttctggcctcatacagttaaccaactctttcacaattgaaagaccgccgcctctacttgctgctagatgaagagttgtgtcttcactatcatttaacggaatgcgtaccatatcaggacatttctcaataatcgattttgattccagccactcatcccgcaatatatgtatcctcagatcttcttttaaagatcctgcaatcctttcaaacttcacattataaaatgtcctttatttaataatcataactttaactatttagttgcaaagaagacccttttaatttatcgtttaccctaaatctgtaaaaattctcttggaaacttgtctcatattttgagaattcctaataatttcatcatttcgaattcatttttttttcaaaatgtaaaataaacaaactcttaagacatgatctctgaaatacaccttgttgtgaatgcaatagtttaaagtataacttactcagctcttctggagtcatttcattcactcctctactttcatgttctggtgttggtgagtttgttgaagtggcaattggagtttgctcatgactttgattggttgtttgatctggtgttggtataatctgaattatgtggtcatctgaaacttcgacgatattggttttcatgatttaattctagggaaaatgaagtgatttggatacctctctaaaatgaagtgatttggtttccctgttctagggaagcttgaacatattatatatggtggtaaaacaagagcccttaattagttttccaacttacacttaaaataattattcccaatatgacattttgtggattacagcaatgttcaatctgttccacacctcaaccctacagttttcaaaagctttttaacttgaatggtttctaaatttataatattaattcttttttaaagtgaataaatatattcattaaatttgttaacagaaaaaaaaaatcattatagaaaaaattatattcattaaattgtggggattagcgagactcagctatcatgacactgttaattaacttactctcaatttcatattacctgtcttcgttgtacaatgatatgatagaggtggttatatatttattatatatttatctaacttccgttgacgcatttataatagttatagtcaactactccaacaaccattgaattaaaagcaagactagatgcattttgttatcgaaaaatgtatgaattttattaaactcactacaacaaccattgaattcaaagcaagactagaaaaaaaaaatacttatttaacattttaatcaaatctattcagttatattgataataatttttatgatgtttttatctctttatgtatgaaatttaatatattaataaatttgtcataatttttattttcaaaaattaaaattaaaattttcatttttaagaaattaatttattaacattttatacatttcaaaagataaaaataattaataactaacacaatttttataaagtttaggaagacgcaaactataatgggagagtgtaatgggtctcttagagtcagaaagtattttttgaccatcagttaccttgtttaaaaatcaatgaccgtaaatttttcttctttgattattattttccctttttttgtcctcctctttcctgtactacccttttcctctttcttcttctcttctttcccattcttcctctcttagtctaagcgacaacggtggtgccatgacagttgatgatagtgggaatgttgatgtgtcgttgtctgacctttgtgcggagtaaacttgagagaactcgagagggtcttgcgttgttttgccacaagatttcaacaggagaaaaagcatggaagacgaaacagtcacaaagcttgatataactattgcctcacttaaacccaaattggattcaattgaacaaacccagattttagtctcccaaagttttgagcttttttatattttttgtgtacgtgttgatttttctcaagggtgtcaagttacgagtttgtttcttgcataaacgttgtttctataccattttactctcaattttgaatccaatttgggagaataaaagacctaagattttggttttgaaaatcaaatgacattttttatgacgatttgtgattatatttgaaattgcagtttcaaggaaattattgtaccattgatatgtaatattttatatttgtaacctggccttgttttctatgtggctctgcagccatagtgaccatatgtggatgtggaatagggtaaaaggaggaaagggaggggttgccgaaaattgctttctgcgtaggtgtcgttgtcggagacaagaaaaatggaagaaaaggaataaatcgacaatgatgatgaataagccagagggataaatcgggaaaatcaagaagaaaaggaaaaaatataaagaaaaaagaagaaaaaaaattcatccatgggattaaaatttgataaatctaatggtggaaattcactttcccattgtggaagacctattatattctcccacactagtctttgttagattagagattaaattattcattatgaaagatttaatactaaaaataatattcaacgaaagtattgagtctaaacatatattttatccaaaatatttcaaatcttgctttgaattagttgttgacacttgaaactttgtttcatactaaatagtgcaagatgtaactatatatataaggtttaggatttaggatttaaatcatggataataagaaccctaaatcctaaattataaatcacatggaaagaaaaagactttgacatggtgtaacatcccgggcgctgacgagggcggggagtgatcgccggtgcagtgaggcacggacaaagagcggctcctggcaggcttccagtgggaggggtacatgaatgaatcgaacacacacccgaacgagagggatccagaggctgtgcaggtatgggactgtacagttgaggataacttaaaggatttaataggtactacctataccaacaaggtgcatctacttttcggtcgcccataacataagaactccacagttaagcgtgcttgacttggagcaatcttgggatgggtgacctcctgggaagtttctcaggaagtgtgtgagtgaggacaaaacacactgaaaagtcttgtgttggtatgtagggacagtcgttgatcctgcaagtggccgggcgttacacatggtgtatgtgtagtttacagaaaagataacatggattaattatagtatgtttgaattttggctttaaatttatcatgaaatatggtgagataagtcaaatttaattttatctaaaacctgttaaatggcttatgactccacctgtagtaattttacaatttataatttttatgtatttaattattatattttaattaataaaatatattattattaatatgttagtatttaagttaacattattttattatcattataatacatatttatgacaatttaataaaaccatgataataaaaaattaccataattattacaacaacatgttagtgttaattaaattataatccatattatctcatgcatcaattatttttagactataaaaatattcctaattaaataagagcaaaattatattagcatatatatttagaagagagaaacattaatgaccataatatttttgaaaacatattattttaaaacaaattttttactatcaactttgttaattattttttaatcttaatgaattagataattgagtcttataaataggaataaatagtataatatagtagatagtagatagtagattttgcatgtttagttattttagtataatcaattttaattgaaaaaaatatggtagaattaaagtaggaatagcttctacttctatcaaaataaattctagtagattttgtctaatttactttcacatcaatactcttatacatatctgtttttttttattgatttaaaaacataattaaaattcttgctatatttatagattctagttgttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattctttcttattttattgtagatgcactttctcttatatgctaaattttatttttcatcttgtccttaaaaagtaaacaaaggaacatttgtgtgcatcacttagtgcatcaattggaaacatttaggcaattagctatttacgcgtaaatacagaataattaatacgtaataactccaatggtaacatttatttgtagtcgttaatattgaaataggatgccaaatttgtacagccctacaccgtatgtaccattatacagtgtagctgcatttattccatacatataacatgcatatttaatactaccttagatttttttataagaaataaattttagtgtagaatacactacaatttatttctcttacattaccttcgaaggaataatgcaatacatatatatatatatatatatatatatatatatatatgtaaaggcggatccagccttaaattttgatataaaattacaaatataccctcatcattaaaaaaattcacaaatatagcctttgtgagtctgtctgctatgctctgcttcttcctctctccctgctccacgcgaccacgcctccgccagcaccacgcgttctgctattctgtttccgagctcggtgcttctgcttctccgcttctaggcttctggttctggactccgaggctgaaggtgaaggctccgactccgaggccctagctgccggctgcgtgcctgctttgccgagcttccgtctccacggctccacgcctccacagtccacctccaggttaagttttgattttgtttctcaatctggccatacatgatacacatattgcatatttaatagaaacacataaacacaaaatcaagcataaccaaaactaaacacaaaaaaggggaattaatgagggttttgaaagagaggagtaccgtgaatttgatcccatttccgattgttcatcactggcttcagaatgcaagtttaaaatttgttatctataaccagagagataatagagtagaccgtaccgggaatttcgacgacaagtcagttgtgttctgctttgattatgtccaaagcttagtttttccgtattgaaattggtctcccctgcatttggttgtatgaatttatgttaaattatgtaagtggtttcagaatcttcccatttattgtatgaacatggaagaatttttagtttgattaatatgttggctattgctaatggtttcaaaatcttcccattcaagctacgatgctctagttaagtagttatacttggtggttgatcccctgcttatttgcattgaaccagtcagttattgctttggtaaagcatttcatggaaagtaagaagctagttgcatctatttagttgctgccaatgtacttaaggtataattagtactgatttacttataaaatatattgtgttcaagtcaaccacatcagaaatgagtacataatcatgcagtttagattctttagaaaggaaaaagatgttgatagtttgtgtagtctttgactcttaaggtatgttcaacactgtgcaacactaaagggaaagaaagaaggcattttgagagaggggagcacctgttgttgtaattaatctactcatcctttgtttgttactttgtttactagtggataaggattattttcaaggatcttgctatgatgatcaatagttgctagctagattcatttagtcggtgctgctaaattatagatgctaaagtcaatgatgtttagaaattagatcataggagacattttgtcagttttataagcaacaatgaaaattacatagtttaggcaaattggatttctctttaatggattggtgaagagaagaaaaattaactgctatgtaattaaataaatgtcttgatttgttcaaggaaaagcaactctttaaccaagtgaggaatgggaatttggagattgagtgatcattttaaaatctaagtgggctttggtgtccagtgttagagttaactggttaaccgatacatgtctgcataagttgactgaaacttgtaacaacttatgttgaattagcttcttgaataatcccgtgtgccaattaagtaatctttctgtcttgaaagaattgacacgattttctacagtgattatatgaacagtggactattagtaagttgaaatttgtatctatccatctatttgcttatagatataggattaatttaagtttaataaatgcactagtaatttaagtttaatatagtgattcttaagataaatgggttgctgagagaataaggaattgcacgcatcaaaataaaaggactggatgatgttttgtttctatgattaggagatccttgggtgattagcatgtatgatattttggaaaataaatggagccaatttcttaagttttggttagctaatagctatctttatttctttcaatgggtatcttaatgcataagtaactttacttatagtaaaatgaggtgggaaaactcaaaaaaagtagctttgtctaatttaagaaagtaagagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttgaatgttccccttgttttattttttggattcgccaaaatatatatatatatatatatatatatatatatatattcttgatatatatactaaaactttcaccttgccaccacatttataatattctctaacctgaaaaaaacatgaaagacaagacacatttaataatcccaacagacaaagacactatggatctgaatgcccagaatatttggtcatggtagtttagtaaaaggataaattatcttttcagtccatatattttttaataaaacttgatattagttgttctcaaattttagtcttaattaatttaattcttgaatttgaaaaaagacaataatttgttcctcctcagaataaaaataatgatgaaaccagtattatttttctaaggtttaaatattaatttgatgaaaataaaaatatggaaactaatagtaattaatatttatcgagagcacggagattaaaaatatgccttgttaaggctagatcgacaccgaaagaggtttaggattttctaaatacacggattccgtaatcttcatacacatataattaattttattttgaatattgaattatttctcatgctattactttcataacaattttttttaatatatatttaatacacatataagtttacataataaattatgttaagaaaatataaacaaagaaattgtttgaaaaaaattatatattttttaataattatttccattatttttctaatctaagattattattttttattatataatatacttatttgattttgaatatgtaagcaccactaatcgcttctctataaaactaatctcgcgtcaaactagtttgtttaaatttaaaataaatattttttaaatgagcacttatttaataaacaaaatacgttgatcaaaataagcacacaacttttttaagcataaacacaatttagacaaatacactaaaaaacagaaaattatttattttattaaaataaatattttttcaacaaataaatttaagcatacttattgaagaacatcacttgatttacaagcaggatttgggctaattagctagtacacattaagacaattataaagtgattagaataattaactacccagtgtgggacttgcgtgtgcctaccatgaggtgaaccttatctaaggtggaacataaagaatattcttatggttttgaatctacttggaatactaataagaaagacgtgaaactaaaattccaaagtacaattaacttggtcctagctctagatagatccacatgcttacatgcctccgtccctaattggagatatatgaagtttatatttgatatggataagttctaggaaacacagaatagccgggactcaatctcaaaatttggaatatctataatttcttattaaaatgctgatctaaatggttcttaacaaaataacaatggttgtgacatatacttgctcccttcaccaaccacagggaaagaaggggcaaagctttgacttaggatatgcagttttcggaaaaggcattatagtctcagattaagtcggaaacactaagataggaaatgcacaatagtcttaaattcaaagacgaacttaattgtttcacaaacaaataacacagtgtggacactgccacactgtctataaatcaagatacaaaatctgaggagaaagttttaattagattttgccagtgtctataattatgtaataagttactagagttcgaatggaagataaaatctagaccacaagtgtttgtcgaaaaagttaaattgaaagagaagaaacagaagtattgggaaaacccccattgaagccactgcatgagaaacccacttggaagtgtgttcaaatatcaaaaaggaggctgcaatgaaagccacaaccatagcagcaacggagataataagtaaccaacgcccaaaagtcaagctgggatgtagtgatatcataaattctcttagtccgaaacttaatgaagttaaatttgacaagaatgagagtaaagacgcagaagaagtgaataatgtgactgtatttgtcaatatgaagacactaaaccacgcattggtcttatcaccaggaatagtcagaccaaccgcaagtgctacggtagcaattgttgacacaagcatcccagattccggtactgtggtaacatgtggcttcactaactctggtataagttaaacgataaaatctagaccacaagtgtttgtcgaaaaagttaaattgaaagagaagaaacagaagtagttggaaaatccccattgaagccactgcataagaaacccacttgggagtgtgatcaaatatcaaaaaggaggctgcagggaaaaacatctaatccccattgaagtgtgataaaaaaattgtaagatatttttgcacatgtggctcatgtgttgccaaacattaatttgtgttattagaataactcaacaaacatcgaataccattactaattcaggctgagtgctaataataaagctcacatccacatcatcatttcctgattttattgcatcaaacacgaggagcccaagagaaataacaaggtaatatatcaattacttctcagtagttagcttaaatttttcttgtgtgattaaaccttctccggagtaatagtaattatctattgtctatgcagactgtgaagcttttgctggttacaaaagaatttacttcagtcattcgggaaattcacaagttgcgtcactgacgtgcgaatacaagtacatttaatagtctgtaatacaaagaaccaaaactatctggttttgttaaaacttttggtgaaaactgttgttgtaattgagcaaactattcactatagaatcagcactagcacataatgtggaaattctagctgagagatgcaacattctaaagaaccttgcagcagcttgatgttaaatattatatgaacaatgatttttttttttttttcatgatttgcacagagcctggacattgcagtggcagaggaagggggtatcgatgtcagaagagaagcatgaggaataccctgaatggtccttgtctgatatggaaaaaatgaactttgatcccatgcagctagctgattaacttaaatggaaggattgatcgatgaagaggattatgatgaagaaatgtagatgaacctgttttggtttagaaagttctaattgagaattagagtagaatgtttaggagtagtattgcacaaatccttagtggttaggaagattaggagggacaggacattgaaaactttagtccttacaacctttgttttaggataaaagtggagatatatattgttccagttagaaatagccaatgtattgttatttgagaaattttaatctcatataggtcttgcctatggtaggcactacattcagatccttaaacttacggatattgattttgtttggattgtcagctttgattgtggcgttgtgtatgtaagtctgttattgtatcacatgacgtttcctatcgaggacaatttgagagagcaaatctgcggagcaaactcactgatccgacgacttaataatgatttgcacttggaccttttttgttatcttgaatttgatgagaaatcagataaatggaaaagaaataagagggatagaaataaaagtttaatatctatgtatagaacagttttaggattttacaaattatcattccatcataaattattattttaaaagtcaacaaatttgttatacatagaattgtgattggatgattatataaatttttttatattctcaatttattatacatagaattgtgattggatgattatataaatttttttatattctcaatgcataactcttttctagaaataaacacaaaataagatgaaaaagatgtattatatagatgaatagaaataacaagaaaaaatgtaaatttttatttgtttaaataaataagagagtagaaaacaaaaatatggtcattgcaaaaatgttcatagaaataaaaaatcaaatttaatttgaaaaccctgaactttttatttcattatttatcaacataaaaatattgttataaaacaataatttgaatttttaaatttaaacataagtaaaaaaacactgcaaacaattttttcctccatttcacgtctcttaatgagaaatatggtttggttaggactcattaattataatttcatttttcattttctgacacattcaatcaagaatattttttttattacttatttctcttcattttaattttatacttattataattttgttgtatataataattccttttaaattgattaagattaagtctcaatgaaagatgaatttataacaaaaaaaaactttttatgtgatatgatttgctcccgtcaccaatccacatggaaggaaggggaaaagctttgacgtgggttatgcagcatagtctcaaattaaggcgggaacaataagaaaggtaatatttcatgagatagaaaatgtagaataatctcaaatttaaacacaagcttcattgttccacaaacaaataataatacagtgccttaaagttatgccaatgtctgtaattctgtaataagttagctagtcctgtttggacaaacgagaaaatctagaccacaagtgtttgtcgaaaaagttaaattgaaagagaagaaacagaagtattgggaaaagccccattcaagccactgcataagaaacccacttggaagtgtaatcaaatatcaaaaaggaggctgcagtgaaagccacaaccatagcagcaacggagataataagtaaccatcgccctaaagtcaagctgggatgtagtgatatcacaaattcgctttgtgcgaatcttgatgaagtgaaatttgacaagactgagagtaaagacgcagaagaagtgaataatgcgactgtatttgtcaatatgaagacagtaaaccagacattggtcttatcacctggaacagtgagagcagccgcaaatgctacggtagcaacaagtgttgacacaagcatgccagattcggctattcctttggctgtttccttaatttcttcggataacttcttgtgttcatcataaaatacatcaattggcatcttgcccattttgtttctcattgctcttagttcacgaggaacattcgactccacgaactatttacaaatcaagagtacatgtaaatgatggtatccaattgcataacttaattaatcttataacttaattaatctttcaattgtcacttaattaataactagagcaaattccagcaatacctcctaaaatttagtgtaattacacaaatatatatatatatatatatatatatatatatattctcagttataagcttaaaatttgaagaaatgttagtgtaatattttgaaacatataagaaatgttggtgtaatttttcaaacttaaaaggagttagtataagaaaataaaaaaaaaatggaattacatataactacacgaaactggagaacaattattgtaatttgctctaataactattagatattaaatttgtaagaaatacaatttcaaagttaagatattttaaaaataaatcttacgggtgatatttattgttacaaatgcacgtgtataatttttaattaaaattttctatgcatatattggctgtttaactattatgctaaagacaatggataacaaattttaaaaattattacaataatcaacaaatactacatacaatgatttctatttttaatgaatacttgttacttttaaagatttaaaatcagtctagttaataaaagcctaaaatttgtggaattttaaaaattttaaaataagattgctagaactgatggatcccatgcgagtgaataaaaatggttgaataagaaaaactaagcaaattaattgaccttgaaccatcggagctccctttgcatttgaaagcttgctcttaaactggacaaatcttcgaattcaactcgtggaagatgcgcagccaagtgtagaatgttgttactttcattgtccacttctcgtactatatgctcttctaatttcgatagtatcctattaaatattccatttcgtcgaaatagcacaaccaagtgcagtaggttccgtccattttcggggtcctttattctcactaattcaggctgagtgctaataataaagctcacattcacatcatcatttcctgattttattgcatcaaacagcactgacgaagtctccaaatagccaacgacattctagtctctcgccctccttcatgtctagtaagaggtccatatatagttgattggtccaaccaatatttaacatgaaatgaaacaaacaaaacttaaatttaaattttattcttatatataagaagcaccatttttttatctctatttaaaaaattatatattttaatccgtacatgaaaaaaaattgtaagatatttttgcacatgtggctcatgggttgccaaacattaatttgtgttattagaataactcaacaaacatctaataccattattacactggatatagatatttaaggactaattcttaattttttttatataaaacaattatatataactttctaaaataagaatcaaaatggaaattaatgatgtcaaataagacctaaattttagcttagcgcacacacacaaaaataaaaagccattttcaacatgtgaaagcttacctaatttttttggaggctttcgcgccagcatatgcaatgctgtaaggttctctttatttcttgcaatggccagagtagttggatgttttccaaataatcgcaatgccaaatctgttatatgcacaaattaagtaaaactccaactaaattgaaaaaccacgtacttagttcatatgtatctccttttatatatctgttatatgcacaaattaagtaaaactccaaccaaatctgtctcgacgtattgctacatgaaaagctgtgtctccacttgagttttgtattagcatgtcttctggcctcatacggttatccaactctcaaacaatttcacggctggcccaacgtactgctacatgaagtgctgtgtctccacttgagttttgtattagcatgtcttctgctcattctccctgttatgtcaaacaaaatagcactcaattgtcaagcttaccactttaattaatctgagttgtgaatcaaaattcatgaagaattgagatatgagttagatatacaatctcatccacctaacagtcaagagaggacaccgacaagcaatgcattccgtgaaattatatattcaagatattacctgaaattactaagagttaataactgcgttatttctttatttacctccagcaatgtactccacattaggattgttagccaattcttcatacctgagatgattataggatgatatgaaaaaaattatcttaaaaaaacatcctgctattaaaatattagcttgaaaagaatttagtgaggagagaaagctaaaaatatttccagagctggaggttgaatatccaattattacaccaagttctcaatttacaaattttctaaaaaaaaatatacacatcaagtatttagtatgataattaactaaaacttgagattttccttttccttaacaacagtcaaccgtaaagcataggaagagcaaagcggatgagaagtgggtataacagtttcatacatcccaaagacaagaaccacatcatattagtatgtttatgtaattaagaacttgcaacactgacactcacagtaccagaataacagtaggtttaataaaattgtcaaacaactaacataaattcctttatctcaagtttttaaacaatgaacattgatactttatatttgtctgggaaagtaaaatagttctaaatcttccaataagtcactgataaaataaatcttccaataagtccccctaattattctctttaagtttcccatttttagcctcggaatcaaattaagagacaaagtcatttagatgcaagatccaagcaagacatcaatgtacttagaattattccaataccacctccatcaagagaaaaaaacaggaataaagaaaatagtagggcaatatagaatttgaaataaatgagcaacttactattttttcaaatagttctccattaaccaactaacagctatgtctgcatgaaagaaaaatggtaaaatacacacacaaccttatggctaattatagttgctccagcaaagaagtatcttgtaatccagccatcttcatttttgtccttcatgaagaagtagccagtgggtaaatgaattgtatctatgaaaagttaaaaactcactactctttgttaagatattgactaatatcataaacaaaacaaccaacaaatgatgatggccaaactgattaacagcgttatgttcggttcacctcaaagtggtaggcaaatgctttgtggcacatgatatgaacaaattaaaggctatcctttttcatccatttggatatcttcatgagaagatctttatagttcttcatatgctgcatgaaggtcaaaactgacttttaaattcaagaaaacatggcttcaacattaatcaatttctcgtccaaaatctattatgttttgatttttttttttccaaagcatgttttaaaataaaaacagaaacagttgaatgtattctcatcctcttcttctatctggtgatcctagcttaagggtgtgagtaatctgtagtagtgagacatgagcttagtgtggatgtccggtttatttaaactaaaaacatttttttttaaaatagaaatcaaataaacaggatcaatgtctactggcagcatagaagtcaaaggaacttctaagctaaaactaccaatcaactactgctttatttttaaacctttctattatgagtttatttaaaatattattaagccaaaacaaaaaaagcttgtgcaaaagtcaatacataggttagacgtttcataatcagcataaggaaagataaagcaagagggtaaaattagttttttagtgtgagcaattttttttaaaattacctgtaattgagtttgtttccgagcactaacttgaagaaagcggtaggcaattcataaagttgcgaatttgtcccatcagtgtcgattgctatgggcatctgttgtagagctgaaagagtagcagacatgaaattgataagagttgatattgttttgatgttgagttaagaagagagagagagagagagagtgagagacagtacaatgcgcaaagtgaagaagatcggagagttgaagttcggaggatgatttgtagccagagcgaaggatattagccaccatgaagcgaccatatctcctagtgacaaagtcagggagcaagttgcgttcgagtgcagccagaatgagcttcaccgcagtgttgtacgcaagctgcttcatcccttccattaaaccacgccctaggtgaggattcagcggaaatgtcagcatttgcgacgtgggaaagagagagagagagagagagactgagcatatgatgaaggcagaagagttggaggatgaagctgaaattttaatttttttttccgcttcgtgcttggcttcggattctggtggtggttcccttatggttcctgctccggatgaagaaactgagaaactctgttagcatgacacgttttattcgaagcggaaaatttttgtgagaaggacttatgtgctccatagttgagagctgctgtaaggttgacagctcagcaaaaccaacattgttttagtatatatatatatatatatacatatagaatatagatatatatttatatgtatagatattatctagaaataatatttatatataattgtgatttgatgattatgtaaatttttttacattttaaatatataattcttttttataaataaacataaaataattaaaatgaagagatctcttatttagatgaataaaaaataaaaaggaaaaaatataaatttttatttgtttgaataaataaagagtagaaaataaaaatatgatcgttgcaaaaatgttcatacaaataaaaaatcaaacttaatttgaaaaacatgaactttttatttcattatttctcaacataaaaatattttgttataaaataattatttgatgacattaaaagaatactgctaaccatttctctgtccgtttcacgtttcttaatgagaaatatggtactcattaattataatttcattctcatttcctaacacattcaatcaatcaagaatatttttttatttttatttatcttcaatttaattttatatttattataattttgttgtatatagtaattcttttcaaatggagtaagattaagtctcagtgaaagatgaatgtgtaataaaaaaaaaagagctttttctgtgttatgatttgctcccttcaccaacacatggaaggaaggggaaaagctttgacctgggttatacattatagtctcaaattaaggcggaaacaataagaaaagtaatatttcatgcatagaaaatgtagaataatctcaaatttaaacacaagcttcattgttcaatataaaattaacaattctttgcgttaaagttatgacaatgtctgtaactctgtaactctgcgtgtaactctgtctctaactctgtctcttactctgcctgtaatctgctgtaataagttaatttgtccagtttggacaaacgataaaatctagaccacaagtgtttgtcgaaaaagttaaattgaaaaagaagaaacagaagtagtgggaaaagtcccattgaagccactgcataagaaacccacttggaagtgtgatcaaatatcaaaaaggaggctgcagtgaaagccacaaccatagcagcaacggagataataagtaaccaacgcccaaaagtcaagctgagatgtagtgatatcacaaattcgctttttgcgaatcttgatgaagtgaaatttgacaagaatgagagtaaagacgcagaagaagcgaataatgcgaatgcatttgtcaatatgaaggcaggaaaccacgcattggtcttatcacctggaacagtcagagcagccgcaaatgctacggtagcaacaagtattgacacaagcatgccagattcggctattcctttggctgtatccttaatttctttagataacttcttgtgttcttcataaaatacatcaatcggtgtcttgcccatgttgtttctcattgttcttagttcacccggaacaatcgactccacgaactatttacaaatcaagagtatatgtaaatgatggtatccaaatgcataacttaattaatctttcaattatcacttaattaataactagagcaaattaaaacaatgctttatgaggtttagtaaggtttgagggaatgttaatgtaatgttttgaatataagagatgttaacttaaaagttagtgtaggaaaataaaaaaataaaaaaaattatatataatgacacgaaacctcaatgaattattgtaatttgctttaataactattacatattaaatttgtaagaaatacaatttcaaagttaagatattttaaaaataaatcttgtgggtgatatttgttgttacaaatgcacttctatagtttttaattaaaattttctatcaatctatatattgcctgtttaactattatgcatgctaaagacaatggataacaaattttaaaaaattgttacaataatcaacaaatactacatacaatgatttctatttttaattaaaacttgttacttttaaggatttaaaatcagtctagttaacaaaagcctaaaatgtgtggaatttttaaatttttaaaaaaagatttttagaactgatggatcccatgcatgcgagtgaataaagaaaaactaagcaaattaattgaccttgaaccatgcgatatctctttgcatttgattaatgcttgctcttaaactggaaaaatcttcgaattcaactggtggaagatgcgcagccaagtgtagaatgttgttaccttcattgtccacttctcgtagtcgatggtcgtctactgtccatggtatcgagtataatattcttttttgtcgaaatagcacaaccaagtgcagtaggttccgtccattttcggggtcctttattctcactaattcaggctgcagagtgctaataataaagctaaaatgcacatcatttcctgattttattgcatcaaacagcactgacgaaggattagttatctcgtctatcatccgcttatgttccaattggttaacttgactccataatttttcaaatagccgaccagcttctgatctcttaacgtccttctcgcctggcaagaggtatatatatagttgattggtccaaccaatgtttaacatgaaatgaaacaaactaaagttaaatttaaattttatccttatatatatgaagcaccattttttatctctatttaaaaaattatatattttaatccgtacatgaaaaaaaaattgtaagatatttttgcacatgtgacgactgatgtgttggcaaacattaatttgttttattagaataactcaacaaacatctaattccattattacactggatattgataattaaggactaattcttaatttttaatgatgtcaaataagacctaaattttagcttagcgcacacacaaaaataaaaagccattttcaacttgtgaaagcatacctaaattttttggagactttcgcgccagcatatgcaatgctgtaaggttctcttcatttcttgcaatggccagagtagttggatgtttttcaaataatcgcattgccaaatctgttatatgcacaaattaagtaaaactccaactaaattgaaaaaccacgtacttagttcatatatatctccttttatatatctgttatatgcacaaattaagtaaaactccaaccaaattcgtctcgacgtattgctacatgaagagctgtgtctccacttgagtttggtattagcatgtcttctggcctcatacgcttaaccaactctttcacaatatcaaggttgccgtaactttgtgctgctagatgaagagctgtgtctccactatcatttaacggaaagcgtaccatattaggacatttatcaataatcgattttacttggagccactgatcccaacatacatgtcttatcagatcttcttttaaagaacctgcaatcgtttcaaacttcacattataacatgtcctttatataataatcataacttttactatttagttgcaaagaagacccttttaatttctcgtttaccctaaatctgtaaaaattctcctggaaacttgtctcaaattttgaattcctaataatttcatcatttgtaaattgaaatctacctgagaaatttgagattatgtagtagtcgaagggatccaatcatcaatcacctttaattaagtttgaaaattaattctatgatgataagtaaaattgtttttgagagaagtaatttattttttattttcttcagttgacaaaagctaattgatcttaacatgtgacttatttatactcactttaaaaatgattctacttttttttttatctttcgaataaaaaaaatagttttctgaacccattgttgaaatttcattcgtataataatagtataaatattttttttttaacgtcaaggggtttcaaattcaatttttttcaaaatgtaaaataaacaaactcttaagacatgatctctgaaatgcaccctcttgtgaatgcaatagtttaaagtataacttactcagctcttctggagtcatttcattcactcctctactttcatgttttggtgccggcgagtttgttgaagtggcaattggagtttgctcatgactttgattaatctgaattatgtggtcatctgaaacttcgctattggagttcatgatttaattctagggaaaatgaagtgatttggagacttctctgaaattccctgttctataagtgttgcttctttctttccagtctgcgaagcttgaacatattatatatggtggtaaaacaagagcccttaattagttttccaacttacacttaaaataattattcctatatgacattttgtggattacagcaatgttcaatctgttcaacacctcaaccctacagttttcaaaagctttttaagttgaaagatttctaaatttataatattaattcttttttaaagagaataaatatattcattaaatttgttaactgaaaaaaattatacacattaaattgtgtggattaattagcgagactcagctatcatgacactgttaattaacttactctcaatttaatgttaactttcttcattggacaatgatatgatcgatatctttacacacctaaaaagtaaactacacaaactatcccttaagttttgtgaaattatataaactttcttatacctttttaaacatttacaacaatctcgcttatagttataggggcacaaaaaacatgaaaagtttgtataatttcatgaagccctataaaaatggttaatgcaatttattcttttttaaatgtgtaatggaagaaacacttacgcatagagatgttgcgcaaattgactcagtaaaaaaaccttaaccgaaccaatttatcaaattattttgaccaattcattttaaatccaaatagtcaaattactataggaaattggtttgaaatcgaattagttttataaatattagtttgaattgaattgattttgaattagttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgaaccagttttataaaaatgattcggttaattgaacaaacttttgtacaacagtgtaattcatctttttttaaaccagttcagattaatcaagtttattttttttaactcccctatttacggatgttttgtgctttcagaacacctatttagtaaccaaaatatgaatgcatatacgtaagtacatgcaaaaataattacaaaacatgtgattaggagcatatatatagtacattatgggacatttagataaatataaatgtatttcaaaattcaagtattttgtaatgatattttaaatgtgttatagaatagatattacagaacatcttacggagagatgttctttcagcacacctattccataaccaaaatatcatactttcaaaatgcatatattatgtaatatattaaaaaataataacagaaagggcattttaaacacctaacgaatatgtattgttcttctgacatacttattaacctatcatatttcccagaatgcgtattccacaatacattaaaaaaataattacggaacatgtaatctagaacaaataatgagaagtattttgggagtcactcttaagtgagaaaggaggtgtaacgtaagttaatttttataggatgcaggaagagaaaagagacaactcaatgttaataaagaaagaaaaaaaagaaaaggaaacacacaaaagaaactagagtggaccaactcaaaggattatgaaaggaaactagcatgcaccacagttatatatatacaaattaaaggttgaaggaaagaaatcatacccaaatgtcttgttaatgaagaacgatggagataaagaaatgcccgtgggatgtgtgaggaggacccttgtcttgttgttgctgtacgttgatcagtgtctgagtgacgagggagcggtttctgagcaatgttatatgcaaagagagtgaatcttaatgagacttaacggtgtgtgtgtgcctgcagatgaggctgtggactatatataatttattaggtggtccggaacaaacacaatcaatatcttcactgttttttatatgacatatagtgttattattcttttcataaattataaactttgaatgcatgttatgtagacattggttgagattatgaaaacaaagtgattccacatacactatttaattaatttcttgtgggtagctgatatgcgcccagcatatgaggattttccaagcttttagaccaagaattaagcatagagcattcattattgccctctgtatgcgtgttttgagctatcttgatgtattgacaggaaatcgaccaaaataccaagaaaaaggccaaatcagaggagaaagagccaagcctgaagaaacatctggcgccaccagcgccaggagtggcgccaaaggcgccatgggttctggaacctggcgccaagggcgccagtatcgcgcctgtagcgtcattaactctggaagatggcgccaagagcgccagattcgcgcttaaagcgccataacctctgcaagtcggcgtcagaagcgccaaaaccacgcctgaagcgctgcaatcactggagtcccgcgccaagagcgccgtatttcgcgccaagggcgccataagtatctgcagctggcgccaagagcgccgataccgcgccatgggcgccgcattctctgtaagctggcgcctggagcgccagattggcgccaagagcgccacaggtcgacagcagccacattaagggcaaaacagagatttcaggtggagggctttaaatactccaaccaccagcattcaatgcacgtttttggagggagaaaaacacaaacttagggtttttagagcttgggttttcttagctagggattaagggagttgaaggcacaagtggagttgcatctccatcttcttcttctttccttcagctgggtatgcctctttttgtatctcagccacccattatgaggtttggctaagctttcattgtagttagggcactagcacttgatgtaaatttcattgggatgtattgaatgctattattcatttatcaaaagctattttactgcacttgctttaattctttcatctcttccttggacttggccattctttgtgagagtttggagctagggttcacaataggaatattagggctttagtttggaactaagtgtagtaacttgctaacattacctaggaatagggatgggtgcttgtagcttgctcatttatgtgttcacttaatgcttaacttactgaagattactaagggattagaattggagtgtgagttaaagaactaagtacatgaggaatcaaggcttagtcaacttcagaaacgcattagctaaatagcttagataagtgaagatagtaaacaatacatttccattgagaggagcatcatgtgtgggttgccctagccacatctcttgcatattattatccctacaattacttgtcgatattagtttacttgtttacacttagcttttaatttaattggtacacacacagcaatacacaaacattattcttatttattacgtatccaacttatcgattaaaattatagtctatttggtcaaacaatcctcgttgggaacgacaaatcccttttcttatcactctattacttgtacgatcggtatacttgtcgagttcgcaacaatagcatatgccatgacaaaaaaaaaaaaaattgttcagcccacatgcaaataacgtgtactgattttttgagtggggagaaagcaactgcagtagacaagggaaaacattcttcttctttacccaaaattgtaaccttttttgtattttaatatttcctataccttttgcatttatttaatttttttacttatttttatccattttttgaggcgtatatttgaaatgatactttagattagttgtaaagctaagcaaattgccttgttagattcttcggaatgtcattcttttcaccttccgagaagccagaaggggtcctttattcctttgttaaaattactgcttccaagtattccatactaacaaaattcttttcccactaggtgggggtggaatatatggacaaaaattaaaaagccacaatgtcttattataattcatgccataacactaatcattcaaatataattaatatagtttttcttggtctctccctatctctaactaatgcgactaccctccatttgatcctgatgtacttcctttattcggattctatagcttttctccacacatatgtggaaaatagacactaattaaggtcttctgtggccgaccttgtgttgttacattagccttgaccccattgtacatttctctgattgctcgaatatagacaatatatataccgtacctttctatctccacaggaccacaaccttgcgtaatatagtacatgcatatctttattataacttaagctatataaaaagtgttggcttaaatctcaaagtcaagttcatcccaataaaaaaatattagggtttattcttttgataggtcaatagttaatttaaaaacacaaaagagagaaaaaagagaagagaaagagagcatccaaaattcgcatgttgagaatgacagaaattgtcatccttcaatcttcttgatttccttgtttaatcgttagatcttattgaaacttttacagtaagtttattactcaccagtattaacatcttagatagaggcttgtatcatcaccggaaattcccaaaccgaactggttctgaatccgttttctgaagcaagcaacggtattgcgaaggacatttctctcatactaatcgttggatcgcgttcaaactttgaggaatggttaataaaatctgtttctacattctgactgttcggatcattcattgaagtattttcaagagggagtgtttcaactgcaaacagagattatcagaattcttgctctgttctgtcttgtttcagacagtgatattgagaaagagttatctctttacttaaccgttggattattctcaaatttggtcagtgtgttcctctcttgtagtaattcaatttgaccgttgggatttgtgagttgttaatgctggtggtagaaattaatttcgtacagaaacctattttgtatgtttgtctcttgtaatgttttggtataacttttgttgaagttgcttgttgattataatggttgctggaactcttttgtaatctcactttattgatagtgaaaaatttgagtggactccgaaatcgatcccatataaaaaggaggctgcaacgaaagccacaaccatagcagcaatggagataataagtaacgcacgcccaaaagtcaagctggaatgtagtgatttcactaatctttcaattatcacttaataactagagcaaattacaacaacactttatgaggtttagtaaggttcgaggaaatgttaatataatgtttttaatataagagatgttaatgtaattttcaaacttataagaagttagtgtaggaaaataaaaaataaaattatatataattacacgaaactaaggagaattattgtaatttgctctaataactatacgtattaaatttgtaagaaatacaatttcaaagttaagatattttaaaaataaatcctacgggtgatatttgttgttacaaatgcacttgcataatttttaattaaaattttctatatatctatacatagcctgtttaactattatgataaagacaatggataacaaattttaagaaattgttacaataatcaacaaatactacatacaatgatttctatttataattaaaacttgttacttttaaagatttaaaatcagtctagtaaacaaaagcctaaaatttgtggaattttaaatttttaaaataagatagctagaactgatcgctcccatgcgagtgaataaagaatggctgaataagaaaaactaagcaaattatttgaccttgaatcatgcgagctctgtttgcatttgaatgcttgctcttaaactggacaattcttcgaattcaactcgtggaagaggcgcagccaagtgtatagaatgttgttaccatcattttccactgctcgtatatgctagatgctcttttaatccccgtggtatactattaaatattcttttttgtcgaaataccacaaccaagtgcagcaggttccctccatttatggggtcctttattgccactaattcactattcatgtcaataagcatcttcacaacctcaacatttcctgattttattgcatgaaacagcactggcgaagcataatcagttatcaactccattagaatcgaattacatttcaattcgttaacttgagtcaatatataatttttcaaatagccgaccagcgtctgattcctgtagtagtcctccatgattagtaagaggtatatatatagttgattggtccaaccaatgtttaacataaatgaaacaaacaaaagtcaaatttaaattttattcttatatatatgaagcaccattttttatctctattcaaaaaattatatattttaatccgtacattaaaaaaattgtaagatatttttgcacatgtgactcatgtgttggcaaacattaatttgtgttattagaataactcaacaaacatctaataccattattacactggatattgataattcagaactagttctttatttttttatataaaacaaaaatatatataactttctaaaaataagaatcaaaatgaaaatgatgtcaaataagatccaaattttagcttagcacacacaaaaaaaaaaaaagccattttcaacttgtgagcttacctaaaatttctggaggcttttgcgccagcatatgcaatgctgtaaggttctcttcatttcttgcaatggccagagtagttggatgttttttcaaataatagcattgccaaatctgttatatgcacaaattaaatagtgcaaggcaaggtaattaaaaatttaaaactccaactaaattgaaaaaccacgtacgagttcatatatatctccttttatatatatgaaatcaatgagaatttagctgggacctgtttggttttaaaggatgatatcacagtctttcagaaacctaatagtcataattaattatttcaacattttgaattatggtcaattgtaccgaatgacgttggaattgtaattagcttatggtatctgatcggttcaatgggttcgattcagtttgtaaaacatcataatatgtaaaaaagaactagattaaaaaaaggagaaataaggttgtttaattagttttacacttaccaaacatgttgattctaatggtcattaaaaaaatttacttcagtcaatagggaaactcgctagtggcttgtgaatgcaagtacgtctaaatgtctaatagtctgtgaggctaggccccacttcaacttaaagcttactacacaaaggaacaaaactgtctggttttctgaaaacttttgctgaaaactatagaattggcattaaagaacctgccagctgtttaatattaaatattatctgaattatggaactttgtttttttcttttttttttttcatgatttgcacagccagagcctggacataacagtggcagaggaaggggtaggggcagaggtaggggttgtggccgtggaattagaactgcagatcaaaagatgagttcacatgccaagtgtgaagatgattctgatgtattgaagcagaatgacaaccacactcaaagcaatgaaagcatggaaaatgtgccggaacctgaagaagttaagcaaagttttccagcaagcaaaccggctgaagtgtccattcgaaattttgacttaaatttgaacccagatgaggatatggattcattagacacaccaacttcggtcccaactagttcatctgcaaaatcagtgtcagaagagaagcatgaggaataccctggatggtccttgtctgaaatggaaaaaatgaccattgatccgattcaactagcgaacataaatggaaggattgatgaagatgaagaggattatgatgaagaaatgtagaagaacctgtgttggtttattcattacttctcatataggcccgtcattagaatgtttttatggggaattagagtagattttgtaggagcagtgttagatagatacttactccttagtagtttaggaagattaggagggatagggcattgaatactctccttataacccttgttttaggttaaaagtggagatatagattgttccaattagaaatagccatttgccagtatagttatgacttacgagaaattttaatctcatgtaggtattgcttatggtaggcactacattcagattttgggtgtgttattgctctaaatttcacggggatgcctatcttaatcacacttgtatctagcggaactaacttactgctccagcaacatgatttgcatgcaaccttttgaatttttgttatcgtgaacttattgcacgatgagaagaggaaaagaacaagacgttagacggatagaaataaatatgaaataaagtaaaaaagatttgtaatttagatgaataaaaataaaaagcaaaaaagtgtagaaattcattatttatgtttgttttggacaatgaaagagaaaatacaaacagatgaattgtttggaaaaattatacgttttttaaaaattatttccattattttctaataagattattatataatatacttatttgatttttaatatgatggatcacagagtatcctgcaactaaaatagagttgagacgaaccagagtctcaagacactgttaatcacacaattagccaggtaagtgtatcgtgggagtctctccgtgctatgcaacggtgactaattaaataaccacacactttcctagacaccaacggtgtaattaactttatcttgattccaccggtaaggtaagcaaaaatacaccaattgaagtgacacacaagatttacgtggaaaacccaatttgggaaaaaccacgggcaagaccaggaaagattttcactaaaagaagaaagattacagcctctctaattttaaggagaaaacaatatcactctctcttaaaataggagattactctctcacttattctagctattgaagaacacttggtatttctcaagtgtgggatgcagctgctgctgctgcacaccggtaatgaatgcaaagcgctcctttatataggagttgcaaaacgcgtgtgcacagtaacaaaataataaaataacgtgtgtgcacagtaacaaaataataaaataataaaatttgttactgtgcgctttcggtgcgtttgaaaaattaaaatttactgtgcactctactgtgcactttactgtgcactgctttcggtgcgctgttttttcaacaaatctcccacttggagatctgattgagaatcaatcaatctccacacagttctttctatcttgccagttccatgctgtttatgtctccgataggccatacgaggatcgacaccatatgaacttgtcagcattgattggttttgtcatgacatctgctaggttatctttggtgtgtatcttctgcatgtctacacaaccttcctctactacttctctgacaaagtggtattgaactcctatgtgcttcgttctggaatgaaaggctggattccttgcaatgtgcaaggcactctgactatcacaatacacaataactgattgttgtttgtgtccaagttcttccaataacctttgaatccaaattgccactttgcaagcctgagtagctgccatgtattcagcttctgtagtagacaaagccaccacagtctgtaactttgataaccagcttactgctcctcctgcaagagtaaacacatagcctgtagtagatttccttttatcaagatcacctgcaaaatctgaatcaacatatcctctgacagtaaactccgatcctccataacataatgcagcatctgaggttcccttgatgtatctcaagatcctcttaacagcatttcaatgctctctaccaggatttgtcatgaatcgactgaccataccaactgcttgagcaatatccggtctcgtacaaatcattgcatacatgaggcttcccactgctgatgcatacggtactcgagacatttccatcctctccgcttcattgctaggacacatacttgaggataatttataattgacaggaagtggggtagaaattgacttacaatcttgcatattgaagcaccgcaagattttcctcagataattcttctgactaagccaaatcttcctatcttttatgtctcggtaaatttgcatccctaaaatcttgtttgctggtcccaaatccttcatatcaaattccctagccagttgtgccttcaactcttggatccgatctttgttggggcctaccaccaacatgtcatccacgtacaatagtaaaatgatgtaatcattatcaccaaacctcttgtaataagtacaagggtctgaattgagtctattgtacccgaggcaaactatgaaggaatcaaatctcttgtaccaacatctcggcgcctgctttaaaccgtacagagatttggtcaacctgcaaaccaagttttctttgcctttttcctcaaatccttctggttggagcatgtagatttcttcttcaagttctccatgaagaaaggcagtttttacatctagctgctcaagatgtaaactgaatgcagcacacatagcgagaactactctgatagtggtaagtctaacaactggagaaaatatctcattgaaatcaataccttccttttgagcatatcctttaaccaccagtcttgcacgatatcgctccacctgatcgttgccgtctcgtttgatcttatagaccaatttgttatcaatggcttttcgaccttctggaagagcaacaagttcccatgtcttatttctatgtagagcttccatttcttcctgcattgctgccatccacaaagaagcatctggattactcatagctttatggaatgttgatggttctccttcttctgtaagaaggcagtatgcatcatggcttgccataacatagtctgagtgccacgatggttctcttgttcgtcgcactgatcgtcgaacttctgcatcctcggcctcagttggttcttgttcctcgtgctctggttcagcttcataggaattatcttctccgttgttcccatctatctctatagtagtaacttccttcgaagtgctgtcatcttcttgttccctttgcagttcattttctgcaaatagtacatctctgctgaccacaaccttgcgggcagtgggatcccacaggcgataccccttaactccgtcagcatatcccaagaatatacatttcctggatttcggatccagcttggttctttcttgggagttgtacattacatatgcgggacatccgaacacatacaaagaagaataatttggtgccttaccatgccacatctccattggtgtcttcaacccaatagccgttgatggcgatcggtttatcacgtaacagacggtctttactgcttctgcccagaatgacttggctaaactagcagttctcaacatagctcttgttctttccaacagagtcctgttcatccgctctgctacaccattttgttgaggggtgtatgcagttgtgaattgccttttaataccctctcgcttgcaaaatgaaagaaattcaccatctatatattctcctccgttgtctgtcctcaaacacttgatctttctcccagattcaagttctacttctgctttgaagtctttgaaagtttggaacacatctgacttcttcttgattgggtacacccataatctcctggagtagtcatcaatgaatgaaacaaaatactttgctcctcctagggacatttctggtgactcccacacatcagaatgaatcaagtctaatatgtgttcgctcctagcagttgatgtggcaaacttcaatctactctgcttactggtaacacagtgctcacagaaaggtaggtttaccgacttgagcccctgaagaagattacgctccgcaagaatcttcaagcctcgttctgacatgtggcttagtttgagatgccacatcattgttagttcttcttgactggctgaagcaacaaatgcatctccttcttgtagcgtatctgccataagcatgtagaggtttgatgctatcttctctgccttcatcaccactagagcacctttcacaacctttaagatccctccttcaataagcgtcttgcacccgagatcatctaattgtccaatcgacattagattcttcttcaaacccttcacatgtcgtaccccttgaattgtgtgaacaataccatcatacatttttatcttgatggtaccaactccggcaatctctaaggcatgattattccccatgtacacagatccttcagagacaggcttgtaggtgcaaaaccagtctcgtcgtggagtcatgtgccacgttgctcctgaatctactatccaaacatcagtgagctccttttcgcctttagaactgattgctacttcgctgaataaaatatctccttcactagaggtactagcaacacatccttgagaagtacttgcttcattagacttctctgtactcttcttattactccaacaatctttcttgaagtgccctttcttgccacattggtagcattttacattcttccttcttcttgactttgatctactctgatattgactcccactcgagccacgttccattgatcttcctctcgtcatcattaaagcttctgcttgctttgaactctccaatctgtcatccttattcttacatcttgattcttcttcaagaattgccgcagcagtatcattgaatgacagattgtctgagaaacctttatttgtgatgttgatgatgagttgatcatatgaattaggtagactttgaagtagaatctcggcacgttcactttgttgatgtggtccgtcaccaaagtagactcactcattcgaagagtatagagtttcctcttcaagaatattttattgtgaagtgatttaacctcgtacaatttggtgagcacatcccaaatttcttttgccgtcttcttttcagcaacacttgacaacactgaatccgccaatgctaggtgcaaattggcaacagcattgttatccatttctttccattttgcttctgtcacttctgcaggtctgccttcaatggcagctatgcaattatccttcctcataattgcctttatcttcagcttccacagggagaaattactcccgttgaacttctcaatctcaaattttgctgccatgatattgacgatactctgaataatgattgcgccgggtcacactatttttctgtgaatagtgtcgtatacgtgaatagtaccgtatgtatatgtgaatagtgacgaacagtactccgtaaacagttccgcccaaatatgcaaccagtatgctctgataccactgatggatcacagagtatcctgcaactaaaatagagttgagacgaaccagagtctcaagacactgttaatcacacaattagccaggtaagtgtatcgtgggagtctctccgtgctatgcaacggtgactaattaaataaccacacactttcctagacaccaatggtgtaattaactttatcttgattccaccggtaaggtaagcaaaaatacaccaattgaagtgacacacaagatttacgtggaaaacccaatttgggaaaaaccacgggcaagaccaggaaagattttcactaaaagaagaaagattacagcctctctaattttaaggagaaaacaatatcactctctcttaaaataggagattactctctcacttattctagctattgaagaacacttggtatttctcaagtgtgggatgcagctgctgctgctgcacaccggtaatgaatgcaaagcgctcctttatataggagttacaaaacgcgtgtgcacagtaacaaaataataaaataacgcgtgtgcacagtaacaaaataataaaataataaaatttgttactgtgcgctttcggtgcgtttgaaaaattaaaatttactgtacactctactgtgcactttactgtgcactgctttcggtgcgttgttttttcaacataatacaccactaatggcttctttgtaaaaccaatctcgcatcaacctagtttgtttaaacttaaaataagtaattttaaaataaatattttttgaataagcacttaaacaaataacgttgatcaaaataaacaaaaaaaaaaaatctgttttttaaacataaacacaatttaaacaaatatattaaaaaacagaaaattgtttattttattaaaataaatattttttcaacaaataaatttaaacaaatttaacaaaagaacatcacttgagttacgagcgtgagttgggctattttgacacatatcagacagttataaataatgatttggataattaactatccaatgtgggacttgtgcctaccatgaggtgaacgttatctaaggtggaatataaagaatgtttttatggttttgaatctacttggaatactaataagaaagacgtgaaaataaaattccaaagtacagttaacatgatactagggctagatacacatgcttacatgcatccgtccctggagatatatgaagtttatatttaatatggataagtcctaggaaatacagaatagtcgggggtcaatctaaaagtttgaaataattataatttcttattaaaatgtcgatctaaatggttcttaacatatataataagagtggttgtgacatatacttgaagtttgagtttgccactgtctataactatggcaagtgttcggatggaagataaaatctagaccacaagtgtttgtcaaaaaagttaaatggaaagagaagaaacagaagtattggaaaaatctccattgaagccactgcataaaaaacccacttggaagtgtgatcaaatatcagcaatggagataaaaaaaaagtaacacaggctacagtaaacttgctttctgcaaatcttgatgaaatgaaatttgacaagaatgagagtatagacgcagaagaagtcaataatgtgactacatttgtcaatacgctcattggtttggatcaattaatgtcaatgcataacttgattaatcttttaattatcacttaataactattacaagttaattttttaagttaagatattaaaaataaaaagaattgacctagcttgaaccatgcaagctccctttgcatttgaatggttgctctaaaactggacaatgctttgaattcaagtggcagatgagcagcgaagtgtagaacgttgttatcttcattgtccactgctctactatatgctctatctttttttcaagtataaaaaaaaaaagcttatatttcgatatagggcagccaagtgcagtaggttccgtccattgttggggtcccttatcatggtcactagtttactattatcgtcaagaatccaacgaagagcctcatcatttcgatatatagtggattggtccaacaaatgtataacatgagcataaagaaacaagtaaaattaaagtttggtcttatatgaaacatcaattttttgacacacataataattaaataaataaataaaacaccattcgcaaccgatcatgaaagcttacttagaatttctgaaggctttcgccccagctatgcaatgctgttaacttctctttttgccccttcatctcttgcaatggccaaatcaattggatatttttcaaataatttcattgccacatctgttacatgcacaaattaaatagcgatggtggattgcatatgtacaaggctaggtaaatctccaactaaattcaaaaaccacgtacgagttcaactagataaaaaaaaaaaaaaaaaaggatgtttggttttacacttaccaaacatgttgctgctaatggtcataaaaagcagtcgatcgttgaatatccttataagccattttgtgaagcagattctgaaaggacaaaatttgcaccattttgttggacatggccatataatacagccaagcgaactggaagcatcccatctgagtttggtatcagcctagaacgattggatctgcaattctaatgataatgtgctcagtctcattaaatttccctcttttgccttctatttttcacatgcacaaacatgattagacgtataaatgacatctacagaagaaaattaaatgttggaatggtcttacttttggaacatgtgttgtttgttctattgtttaccttcactttctagtttctaaatcacatctatatatgcactaacaatataaaatgattttatataaattatcattttaaaaatcaataaatttattatattacactcttaatacataactcttatttataaataaacaaaaagatgaaaatgatgtattattttgatgaatagaaataaaaagaaaaaaaatataaattttaatttgtttgaataaataagagggtagaaaacaaaaatatgttcattgcaaaaatgttcatacaaataaaaaatcaaatttaatttgaaaaatccgacctttttatttcattatctctcaacttaaaaatactttgttataaaaagataattttattttttaaaatttaaacataagtaaaagaacacggctaaccatttctccctccatttcacgtctcttagtgaaaaatatggtttggttaggactcattaattataatttcatttctcattttctaacacattcaatcaagaatatattttattacattatttctcttcattttaattttatatttattataattttgttgtatatagtaattcttgtcaaatcgagtaagattaagtctcactgaaagatgaatgtataataaaaaaaaaaaaagctttttttgtgttatgatttgctcccttcaccaaccacatgcatggaaggaaggggaaatgctttgacgtgggttatgcagtgtagtctcaaattaaggcgggaacaataagaaaggtaatatttcatgacatagaaaatgtagaataatctcaaatttaatacatgacatagaaaatgttccacatacgaataataatacagtgccttaaagttatgccaatgtctgtaactctgtaataagatagtccagttaggacaaacgataatatctggaccacaagtgtttgtcgaaaaagttaaattgaaagagaagaaacagaagtattgggaaaacccccattgaagccactgcataagaaacccacttggaagtgtgatcaaatatcaaaaaggaggctgcagtgaaagccacaaccatagcagcaacggagataataagtaaccaacgtccaaaagtcaagctgggatgtagtgatatcacaaattcgctttgtgcgaatcttgatgaagtgaaatttgacaagaatgagagtaaaaacgtagaagaagcgaataatgcgactgcatttgtcaatatgaagacgggaaaccacgcattggtcttggcacctggaacagtcagagcagccgcaaatgctacggtagcaacaagtgttgacacaagcatgccagattcggctattcctttggctgtatccttaatttcttcggataacttcttgtgttcttcacaaaatacatcaattggtgtcttgcccatgatgtttctcattgttcttagttcacccggaacattcgactcctcgaactatttacaaatcaggagtatatgtaaatgatggtatccaaatgcataacttaattaatctttcaattatcacttaattaataactagagcaaattacagcaatgcctcctaaattcagtgtagttactatacacaaatatattctcagatataagcttaaaatttgaagaaatgttagcttaatattttcaaacttataagaaatgttagtgtaatttttcaaacttaaaaggaattagtataagaaaaaaaaaatggaattacatataactacacgtaactcgaggagaattattgtaatttgttctaataactattagatattaaatttgtaagaaatacaatttcgaagttaagataattttaaaataaatcttacaggtgatatttattgttacaaatgcacgtgtataatttttaattaaaattttctatccatatattggctgtttaactattatgctaaagacaatggataacaaattttaaaaaattattacaataatcaacaaatgctacatataatgatttctatttttaattaaaacttgttacttttaaagctttaaaatcagtctagttaacaaaagcctaaaatttgtggaattgttaaattaagattgctagaactgatcgatcccatgcgagtgaataaagaattgttgaacaagagaaactaagcaaattaattgaccttgaaccatccgagctctctttgcatttgaatgcttgctcttatactggacaattcttcgaattcaactcgtggaagatgcgcagccaagtgtagaatgttgttaccttcattgtccacttctcgtactttatgctcttttaatgtcttccctgttatactgttaaatattcctttttgtcgaaatagcacaaccaagtgcattaggttccgcgcgtccatttttggggtcctcaaattcacgattcatgtcaatcatcatcttcagaacctcaacacatcctgattttactgcatgaaacagcactggcgaatcattataaggtatcaaatcctttaaaatcccatagcgatggtggattgcatatgtacaaggcaaggtaaaactctaactaaattgaaaaaccacgtgcgagttcaactagataaaaaaaaggatgtttagttttacacttaccaaacatgttgctgctaatggtcataaaaaatagtcgttgaatatccttataaaccattttgtgaaacagattctgagaggacaaaatttgcaccattttgttgtggccatataaaacagccaagcgaactggaagcatcccatctgagtttggtatcagcctagaaccattggatctgaaaattctaatgataatgtgctcagtctcattaaatttccctcttttgccttctatttttcacatgcacaaacatgattatacgtgtaaatgacatctacagaagaaaattaaatgttgggatggtcttacttttggaacatatgttgtttgttctggtgtttaccttcactttctagtttctaaaatgtctgagttacttgcatccttgcctttgtagaaaacagtgagtgcagacttttaatgtctttgattttctaaaagatgttgtcagcagggtttctgatttaggtggttctgttgcaactcgtgatgacatactgtttctaggaggtttgtgctctgattaatactcatgttacttggaacaagttttctgtgtggtgaattttgtttattttatattaggaaagatgatgataatgacagccacgaggagcccaagagaaataacaaggtaatatatcaattacttctcagtagttagcttaaatttttcttgtgtgattaaaccttctgctgagtaattatctcttgtctatgcagactgtgaatcttttgctggttacaaaagaattcacttcagtcattagggaaattcacaagttgcttcactgacttgccaatacagttgggaatgttctttatacaaaagttattgggcttaaatgtataataagggttcaagaaacctaggtttaggttttttaatctcctatataataatcatatttgctctagaaaaatatatgaattgtcatcatctacctgaataacatttatcattcgtaattcgtagttgattgaggaggctaagagaggacttaccaaagacaaagcaagaatgatcttataacattcatgtgtactaggtccaatacgttttctcatattctatgtaatccttcaaattcaagtacatttaatagtctataaaccttattatacaaagaaccaaaactatctgattttcttaaaacttttggtgaaaactgttgttgtaattgagcaaactatgcactatagaatcagcactagcacataatgtggaaaatctagctgagagatgcaacattctaaagaacctcgcagcagcttgatgttaaatattatctgaataatgaattttttttttttttcatgatttacacagagcctggacattgcagtggcagcggaagggggtatcaatgtcagaagagaagcatgaggaataccctgaatggtccttgtctgatatggaaaaaatgaagattgatcccattcaactagctaattaacttaaatggaaggattgatgaacatgaagaagattatgatgaagaaatgtagatgaacctgttttggattataaagttctaattgagaattagagtagtagtattagacaaatccttagtcgttaggaagattaggagggacaggacattgaaaactttagtccttacaaacttttaggataaagtggagatatagattgttccaattagaaatagccacggtattgttatttgagaaattttaatataggttataataggcactacattcagatccttaaacttacggattttgattttgttttagctttgattgtggcgttgtgtatgtaagtcttttattgtatcatataacgtatcctctcgagtacaatttgagagcaaatctgcggagcaaactcactgatccgacgacatgatttgcacttgaaccttttgttatcttgcatttgatgagaaatcagataaatgaaaaaaaaaagggatagaaataaaaatttaatgtatatgcactaataatataaaataattttaggattttacaaattatcatctaatcataaattattattttaaaaatcaataaatttattatacagagtaaattgtgattggatgacggtataaattttttacaatctcattgcataactctgctaaaaaaaaatatacaaaataatatgaaaataatgtattatttcgatgaatagaaataacaagaaaaaatgtaaatttttatttgtttgaataaataagagagtagaaaacaaaaaatatggtcattgcaaaactgttcatacaaataaaaaatcaaatttaatttgaaaaaactgaacttttaatttcattatttctcaacataaaaatattttattataaaacaataatttgattttttaaaatttaaacataagtaaaagaacactcctaaccatttctccctccatttcacgtctcttagtgagaaatatggttaggactcataatttcatttctcattttctaacacattcaatcaagaatattttttttatctctttatttctcttcattttaattttatatttattataattttgttgtatatagtaattcttttcaaatggagtaggattaagtctcagtgaaagatgaatgtgtaataaaaaaagctttttctgtgttatgatttgatcccttcaccaaccacatggaaggaagaggaaaagctttgacgtgggttatgcagtatagtctcaaattaaagcgggaacaataatctcaaatttaaacacaagcttgattgttccacaaacaaataataatacagtgccttaaagttatgccaatgtctctaattctgtaataagtttgtcctgtttggacaaacgataatatctagaccacaagagtttgtcgaaaaagttaaattgaaagagaagaaacaaaagtattgggaaaacccccattgaagccactgcataagaaacccacttggaagtgtgttcaaatatcaaaaaggaggctgcagtgaaagccacaaccatagcagcaacggagataataagtaaccaacgcccaatagtcaagctgggatgtagtgatttcacaaattggctttgtgcgaatcttgatgaagtgaaatttgacaagaatgagagtaaagacgcagaagaagtgaataatgcgactgcatttgtcaatatgaagacagtaaaccaggcattggtcttatcacctggaacagtcagagcagccgcaaatgctactgtagcaacaagtgttgacacaagcatgccagattcggctattcctttggctgcatccttaatttcatcggataacttcttgtgttcatcataaaatacatcaattggtctcatgcccgcgttgtttctcattgttcttagttcaataggaactcttgactccacgaactatttacaaatcaagagtatatgtaaatgatggtatccaaatgcataacttaattaatctttcaattatcactaaataacttgagcaaattacagcaacacctcctaagatctagtgtaattacacaaacatttcctgaagtattagagtaaggtttgaggggatgttactctaatgatttcaaacatataaagaatgtaagtgtaatttttcaaaataaaaaattgttacaatatcaacaaatactacatacaatgatttttatttttaattaaaacttgtcaatttttaaagatttaaaatcagtctagttaacaaaatcctaaaatttgtggaattttaagtttttaaaataagattgctagaactgatcgatcccatgccagtgaataaagaatggttgaataagaaaaattaagcaaattaattgaccttgaaccatgtgatatctgtttgcatttgaatgcttgctcttaaactggacaattcttcgaattcaccttgtggaagacgcgcaaccaagtgtagaatgttgttacctccatagtccactgctcgttctgattgctcttttaatcccggtggtataatattaaatattcttttttgtcgacatagcacaaccaagtgcagtaggttccatccatttctgcggtccctataagccactaatccaggattatcgtgaagaagcctctccacatcccaaaaatttcctgattttattgcatattcacgattctgttccaatgtttcaactttagtcaatacttctctaaatagccgatcacaaacgtctgattccttggcaaacattaatttgtgttattcgaataactcaacaaacatcaaataccattattacactcgatatagataattaaggactaatacttaattttttatataaaacaaaaatatatataactttctaaaatcaaaatcaaaatggaaatgatgtcaaataagatctaaattttagcttagaacacacaaaaaaaaaaaaataaaaagccattttcaacttgtgaaaggttacctgacattccgctaggcttttcctccagcatcttcactgctgtaacgtcctcttcatttcttgcaatggccagagcagttcgatgtttttcaaataatcgccatgccaaatctgttatatgcacaaattaaatagtacaaggcaaggtaaataaaaactccaactaaattgaaaaaccacgtacgagttcattatatctccttttatatatatgaaattaatgagaatttagctaggacctgtttggttttaaaggatgcatgatatcagtctttcagaaacctaatagtcataattaattatttcaactgattccatgggttcgattcagtttgtaaaacttcataatatgtgaaagagaactagattacaaaaaggagaaataaggttgtttaattagttttacacttaccaaacacgtcgaacctaatggtcatcataaacagtcgttcaatatccttgaaatccattttgtcaagcactttttgagaggacaaaatgtccaccattctgttggaacgatttaaagcagccaagtgaactggaagcatcccatctgagtttggtattagcatgtcttctggcctcatacgcttaaccaactctttcacaatttcaagactgccttgacttgttactgctacatgaagagctgtgtctccactatcatttaacggcatgcgtaccatatcaggacatttttcaataatcaattttgatttgagccactcattcaaccgtatatctctcgacagatcttcttttaaagaacctgcaatcctttcaaacttcacattataatttctcgtttaccctaaatctgtaaaaattctcttggaaacttgtctcaaatttagaattcctaataatttcatcatttgtaaattgaaatctagctgagaaattcgagattctgtagtagtcgaagggatccaatcatcaatcacctttaattaagtttgaaatttgaatttcaatttgtgtttgaaaattaattctatgatgataagtaaaattgtttttgagagaagtaatttattttttattttcttcagttgacaaaagctaattgatcttaacatgtgacttatttatactcactttaaaagtgattctactttttttatctttcgaataaaaaaaataattttctaaacctattgttgaaatatcattcgtataataatagtataaatatattttttttaacgtcaagtggttgcaaattcaattttttttttttcaaaatgtaaaataaacaaactcttaagacatgatctctgaaatgcaccctcttgtgaatgcaatagtttcaagtataaacttactcagctcttctggagtcatttgattcactcctctactttcatgttttggtgccggcgagtttgttgaagtggcaattggagtttgctcatgactttgattaatctgaattatgtggtcatctgaaacttcgctattggagttcatgatttaattctagggaaaatgaagtgatttggagacctctatgaaattccctgtgtctataagtgttgcttctttctttccagcctgcgaagcttgaacatattatatatggtggtaaaacaacagcccttaaatagttttacttttccaacttacacttaaaataattatttcctatatgacattttgtggattacaattacagcaatgttcaatctgttcaacacctcaaccctacagttttcaaaagctttttaagttgaatgatttctaaatttataatattaattcttttttaaagtaaataaatatattcattaaatttgttaacagaaaacaatatatccattataaaaaaattatattcattaaattgtggggattagcgagactcaggtatcatgaccttgttaattaacttactctcaatttaatattatctttcattgttggacaatgatatgatatctttacacacataaaaagtaaactacacaaactatccctaaagttttgtgaaattatataaactacacctaaaaattatattcattaaattgtggggattagcgagactcgctatcatgacactatgttaattaacttactctcaatttaaaattatctttcttcgttgtacaatgatatgatatctttacacacctaaaaccttcaatttcctactcttatattgttgacgaaaactttctgccatggcggtggttatatatttatccaacggagttgacgcatttaattatatgattatatcctaactctggtctttttatactagttataatcaattactccaacaaccattgaactcaaagctaagaccagatgcattttattatcggaatatgtataaatttattaaactcactccaacaaccattgaattcaaagcaagactaaaagttacccacattttgattgttatgttggtaattgttgttatgatatttttttatgtatgttttttttttattaatgataacatacaaaaggtaacggattgatgatatataataggagtatgatttggggttggtataaactgaattatgtggtcatctgaaacttcgatattggagttcatgatttcattctatggaaaatgaagtgaattggatatctctatgaaattccctgttcgatcagtgttgcttctttctttccagcctgcgaagcttgaagatattatatatggtggtaaaacaagatcccttaattagttttccaatttgcacttaaaataattattcccaatatgacattttgtggattacagcaatgttcaatctgttcaacacctcaaccctaaagttttcaaaagctttttttaagttgaatgatttctaattttataatattaattcttttttaaagtgaataaatatattcattaaatttgttaacagaaattatgtgcattagcgagattcgctatcatgacactgttaattaacttactcataatttaattaatattatcttccttccttagaatatctttaggctaagatcttaagcaaagattttgagtttaagatctgatcttcattggatctacatcatagaggatgagttcttgtggaagatctcttaagacctacacaatgttcaaaaaataataaattttcttcattttttctctctctttaagatctcaaaatgagatctaccattaaataaaaaaatgaaacagannnnnnnnnnnnnnnntgcacagtgttaaaaaaaagaatagttttttttttcgtctctctcccctaatatctcaaaatgagatctatcactaaagaaaaaaatggaagagatattgaaagattttcaatcttatgtgacattatggaatctactaaaaagtggtctaagatcccaatttgggatcttccactaaagatgagcaatgatattgagcttaagacctagttttcactagattttccaataaaggaggtgaacagaactccaatatgaaaaatgaatttttgtagaagaatccttaagatctacacaatgttcaaaaaaaataatatttccactaaaaaaaatggaagaaatcttcaatcttacttaacattatatagtctactaagaagtgatctaagattccaatttgggatctaccactaaagatgtaagcatctttagtgctagatcttaagcaaagatcttaaacttaagatatgatcttcactagatcttctaataaaagaggtgaacaaatctctaagtatgaagaatgagttcttgtgaaaaaaccctgaatatctgcacaatattcaaaaaagaataattttttatcatcttttttcccctaagattttaaaatgagatctattaagaaaaaaaatgaagagattttcataaatatttaatcatatgtgatattataggtctaccaaaaagcgacctaagagcatatttaatggtagatcctaaattgtgatctttagaccactttttagtagatcctatagtgtcatgtaggattaaaaatctcttatattttttattcttttttaatattgtgcatattttaagaattcttctatgataatttattatttatattaaagatctgtttaccttctttattagaagagctagtaaaggtcagatttttaactcaaaattcttattcaggatatttcaactaaaaatctaatattaaaatgcttattattgacgaaaattttctgccatagctgtggttatatatttatctaccttccgttgtcgcatttaattcttggattatatcctaagtctggtctttttatactagttatagtcaattatgccaacaaccattgaattacaagatgcattttattatcggaaaatgtatgaattttattaaacccactacaacaaccattgaattcaacgcaagactagaaaaaaaaaaatacttatttaatattttggtgaaatttattcagccagtcatatcagggccggtcctgaaaattctttggcccagggcgaagtgaaaaaaatggacccctaatatataaattttttaaaatacaaataatattaaaactaagagatggaaaaaatgggcccctaacacacaatttttttgaaataaatataatattaaaactaagggatgaaaaaaatgggcccctaacacaatttttttgaaatacaaataatattaaaactaagggatgaaaaaaattggcccctaacatacaatttttttgaaatacaaataatattaaaactaaggaatggaaaaaatggatccctaacacacaaaatgagcccctaatatatgttttatttttattatttttattatttttttatttaagctaccgataaaaaaattttgggccctgggcgggcgccccgctcgccctgccccagggccgggcctgagtcatattaatagttatttttgacattttaatccttttatgttacgtaatataaattcttttattaataagaataaacaaaaattaataaataaatagatttgtcacatttttttctttcaataatttaaattttcttatttaaaaaataaatttattaatgatctatatatttaaaaacaaaataattatttattctaacatattttataatgtttagaaacacgtaggctatgatggaagaggataaacggtttctcatcttaagaaagtattttatgaccatcagattatttattttaaaaatcaatgatagtaaatttttctttttttattaatttttttctttttttttgtcctctttcccatactacccttttcctctttcttcttctcttctttcccattcttcctctcttcgtcttagcggcaacagtggtgccatgacggccggtgatagtggggatgttaatgcgttgttgcttggtcgttgtgcggagtaaactagagagtgtctttcgccgtttttcttgcggtgttctgcaacaagatttcaaccggagaaaaagcatggaagacgaaacagtcacaaagcttgatataactattgcctcacttaaacccaaattggattcaattgaccagtgttctgctcggtgagaacagagatgtccaacaatggagttgggcaaattaatgtaggatcaaactctctctctctcaagaagcttatggagacgaagccacttgaggaagaagatcaccgcacgatgaacacgacactttggggggtgcggtgtgtgcaggtgtgaaggaaaagagagagttagaattgtgtgtacctttcaccatgaattgccgatatttataggatacctggagtttgttcatcaaacggttgcgcacgattcctatatatgtggagacactggctcgtgggggataacggccacccccatatttcagggtggttatcgcgggctaacagaggttgtttgactgtttcaaacaagataatacgtttccgtaacagatgcccctcagcccggtcgttttagcattctgaatggccgggatgcacaataggaatgccgatcacgccttctaggggtaatctttgacaagcacaacctaagctcgaaccggtataattgttcgagatccgaggaagttgatgtccgagccgaggtgatcactttccgacttcattttgatactggccgaggtacctattgtctgagccgacattatcaaagccgagccgatgtgaccatgatcaatattatcgcatgctcgatttctgccccttgatttctgccccttgtcgggatatcaagtcttctgtcaattcatcagtcagtcgcttcagtaggctcgccgaactatactttgccttttcaacgcagcctctgccactagggacataggggaattgaacgtctcttattcccctatcgccacgtgtcttattaactgcttcttttctgtatttctcaatcatgacttttggggctaaaggacaatcttgcccctatacccaacagttactctatcatttttgaaatctggcggttactcttcttattttgatgcgccccttccgtttcattgttattttattgaggcaattaattttcacttttctctccatcttcttggcatccctcttgttcgtgctttctgctgcagattcttcgcgtttgtttctcacttcgacttccgcttctgcaaccctcgcatttcttgggcttcctcctcaattctccttccatcatcttcattcgttttccaggtattcttctgctttccttttccttttgtcttctatcgttttctgcattttgttcactttacccgattcttacccgattctgcacaaaccttgaatatcgctttccttcttcatacttcctattcctttatcttgttctgcattattctctttagccatgaaatatacccttgaacaagaggcagaaattcgtagaacttgttctcctcgcgctgctttctggctttatggtttgcccctctctgaagaggagaagagaaaatctttgcttaggaccccttccgcgccaggaaatcccaagactccccttccaaagccccctaaccctcctggattaaggctctctagattagggtcttttaattcagggtcatcgtcccgccaaagaccagcactcctggccttacaatctgggacgtccgctagggtttcccctccttcagatattgcccctccaaatgaatccgaagcttacccgatacccgaaccggatttagtaattcgatatgaaccctgcccgagttgcacagaggaattcatatatctagccagtagagatcgtgataggcaagccgagggagtgttagatcgatgccgacataaccctgtttgggtccataagcctgttccaagagaatcaaaccttcccccgacccgaccgagtcctaacatcgggatgccaacttctgtggaacaggcggtttctgttgaagcacctatccgaccaactccgatctctgctttccgccctttgccgactcttccaggtacttcactaatgattcttttttgttatcgtaggtaattatggactcatctcgggccagaattgttgatgaatccgcaactgggtctcggcctcaagttcctccttcagcgctaacaggtaggtttccttgggtaacccatgaggtgctacaacacacctccactatggattccgaggaccttgcttcgattccctttggggttcaggaaggtttccatgtcggtcttccccgcccgggtgaactaatttgttcttcccgggaagggaatgaccccgacttctttttgttttacaaagatgtcattactcggttgggagtttgttttccctttaccgacttccaaatgcaggtattgaatcatctgcaagttgctcattcccagattcatccgaacggctgggcttttatgcaagccttcgagattctctgtcaaaaactggaacttgtatgtacccgtcctttgttcttttatttctttatggttcaaacaagtcgatccggtaaggaacctgccgaccgaaaaggttggacttctttccggggtcgcaccgatcatcgttctgatcgtcggcttttttctttatacgctgagtcctttaagggcttcaaagacaaattttttaaagttgtggccgaacccggtcaacgtcccttttttgctctttctcctggatcttcctcggaatcctggaagtttcccctatattggtcttctgctcatcatgacctcccttctgcctcttaccgaaccgacgaggctcagttgtcggattctgacgtcacttctgctgcccgaattatctcgtacaaagagtcgggaaacttggcccctatatcttattatgttcggtgtggtcagtcttaattccttttgaaaaataagtctgattaattggcttttttcttgacgcctaatattttgatgtttatgcagctgttgaaatgaaccttagccgtgctcctcggcccgctcatcttgaggccctgaagtcgcggaagaagcgaaaggtggccgggggggggaggggtaaggccgctgctgctgtttctgaagccgcccctacttctgccgtggttacagcgactccccttcctacctctccggcggtcgacgactctgttgtcattttggacgggccgtcggacaatatcacctcggctgctcctgtcacgacggacgctgtccctcctcctgactccgagcacaccgagaatcctctgcaattgtccccccggtctctttggactcatggggttaccgcggactttttggaggtggttcgggcgcccaagaagtattccgacctggttcctttctcggctcctgatttggaggaactgggctccttggaattatcttgtttgaaaactgccaccttgctcagaagtttggcctcgctgaagagaaaggcctgcaagatgtctaccgagtttgaagcctctaaggtcgagattcagcgacttcaacaggagttgaatcttgctcttaaagaggtggagacttctagggcggatgtcaaggcggcacaagaggcggtggtcaagctgacctccgagcttgaggagtcccgggcccaccatgagacttctcggttagagctggaatctgcacgctctaccattacgaagctggaacaggatctcgtggtgagccggggacgagctcgggatgctcgcgatcattgcgaccagttgcttgcccttaacgacaaggggaccagggatcggaccgagctgctcggggaactcacgtttgttagggcttaattgttgaagtctaccgaagcttctttcaataatgctttggatcagattcgcctgttgaaccccggcgtcgagttgaatacctcgggtatgcactttaaatcgtatgtcgggaacggccagctgatagccgtttctgatagcgaggaagaagaggcgagcacggacgcacccgaagaagccgggactccagctgactgtggaaactgaagggccgggatgccggttttattttgtatatcttgaacactcttttcctgttcttgaacaagtattttttttgcacttttttaagtacctttcgtcggcttttataaattgctgttcatttcttccgtatatcggctccaacggccaacttgctagtcggttattatccttggtttagccatattttattgcacccgaactattcaatcggtattaaaaatggaatagggatcatgttcccgtcttagcaactgttaatatattcataacttaaccctttagatgtaattctttcggaaaaatccgatgattcatcctggattgaatagttacgccggcctgatcaggaccgagctaatattaaacaacgactaagcgctcatacttcgtgcacgaagagtgttccttgcatcatggattttattaataattcatgatatcaattacaaatttgcgcgggtgtatgttcccggttcacaattgattgatacaaacatgaaaaaaaaaaaaacttcaactggacctcaaaatagatttgcgcgggttataggttcccggttcacaagatctaatgaaagtcactaatgccatgatcccaatgacgggcccgagggccaactaaagggaaacacatggtgtccatgattccgatgacggtcttaatgtcggctaaagggaaacacatggtggagttccatgatcccgatgaccgactagaagccaactaaaggaaaacacatggatcttgtctgcatcttatcagctatagtatttcttcagcttgtctacgttccaagttcgttggattttcttgccgttcaatgtttccaataagtaggctccctggccaagattttggactactcggtacggtccttcccaatttgccgctagcttcccgtctcgagcatttttgttcccgatatccgctcggcgtaacacgaggtcgtccttgtcaaaggacctcggcttcactcgcctattaaatctttgtgccagcttgcttttttgatggagatcctgacggtgggcggcagcgcggacttcttctatcaaatcaagctcggccgttaaggcagcattgttgtcactctcttgtgatatatgctgccttctccatgatgattggccgatttctaccggaatcatggcttcacagccataagtcatcctgaatggggtttcgccagtagctgtttgggtcgtcgttctgtaggcccacagtacgtagtatagttgctcgacccaattcgggccggcttcttgcattcttttcttcaatccatcgaggatgactttattggccgcttctgcttggccgttggactggggatgttctactgaagcaaagtgatgtttgatatggaggccggccatcattgcttggaacgttctgtcggtaaactgcgttccattgtcggtaacgatttccgccggaatcccgaaccttgctattatggtccgctccatgaacttttgaacccgagctgaggtgatggcggacaatggctcggcttcgatccacttcgtgaagtagtcaacggccactattagccatcgcatttgacccttagtagctttgaacggccccagcaaatccataccccacttgtgaaatggccacggtgcagtgatcaagctaagctcggacgggggaatccatactatctttgcgtgtttttggcaggcattgcatcttttaacatgttctgttgcgtcggctttcatcgtcggccagaaatagcctgcgcggagagcttttagtgctaaagccctagcgcccatgtgttgtccgttgatcccctcgtgtatttccgagagcacatactcggcttgatccgagtttagacatagtaatagtgggctatgcagacctcggcggtataattcatcgtcgaggattacatacatcgccgcttctcgaattaacttttttgcttctagctcctcgtgcgggacgattccttgctctaaatagttgacgatgggtcttctccagtcgtcggcgataaatatgatcatgacgcatgctggtcgggcgagctcttgttggataactgatctataattccccgccccttttgtactagccaattttgagaggatatcggctcgggtgttttcctccctcggaatgtgggcaactattacttcgtcaaattccgccataatttccttcacttttgctagatatttggctagtaaaggacccttagtctgatatctgccctcaatttgtgcggagaccagctgcgagtcggtgaagacgttcacccttgttgctccttgctccttaacctgcttcaaacctgcaatcaaggcttcgtattccgcttggttgttagaagtcggaaagttgagctgaagagactgttcaagggatactccgtcggggttttcgacaatgaccccggcaccgcttccttttgcgttagatgagccgtcgacgtatactttccagactttgtttttctgctgggtggtcgacgttggtgtcaattctataatgaagtcggccaaagcttgcgacttgatagcctggcgggcttcgtattggatgtcgaattcggacaactggatggcccagttcatcatccgtccagccagatccggtttgtgcaacacttgtcggatgggttgattcgttcggacgatgatggtatggccctgaaagtatgggcgaagcctttttgccgtagtaactaaggcgaaggccactttctcgagtttctggtatctcaactccgagttcttgagggcccgacttacaaagtaaaccgggtgctgagttttatccacctccctgaccaaggcggtactgatagcttcttcaccgaccgagagatacaagatgagcgtttcccccggttctggtgttgacaacacgggaggtgaggccaagcatgcctttatctgttgaaatgcctcttcgcacgtcggattccatccgatcttagcttccttctttagaagcttgaagaatggaagagccttctccgcggatcgtggtaggaatcgggtcagggctgccatccttcccgtcagctgctggacttctttcttgctggtcggaacttgcatatctaggacggccttgcacttgtccgggttcgcttcaattccccggtgggtcaacataaaccctaggaacttcccggcttttactccaaatgcacatttcagcgggttcagccgtatattatgctgccgcagcttttggaaagtttcctctaggtccttgatgtggtccccggttgcggaagtcttcgtgatcatgtcgtcgatatacacctcgatgttacgcccgatttgatccgagaagactttattcatcattctttgataagttgcccctgcattttttagaccaaaaggcataactttatagcagtaattagcactaatacctcgaaatgccgttttttccttgtcgtcggggtgcatgggtatttgattataccccgagtaggcgtccatgaatgatagcagtcggaaaccggcggagtcatctacgagttgatcaatgcttggcatggggtacgagtctttgggacagactttattcaagtcggtgtagtcgacgcatacccgccattttccgttgggcttcttcaccatcactacattggaaagccaggtggtatattggatttctctgataaatcccgccttgagcaattcttcgatgtgtttggtcaacgcctgctttctgtctggaccgagcttcctatttttctgctctatcggcttagagccgggatacattgccagcttgtggcaacaaaaggtgggcttgattcccggtatctcggatgccttccaagcaaagacgtcctgatttttcttcaaacattggataagcctgcctttatcttctgggtcggcctgcttgcctaccttggtggtttggaacgaggagtcgccgatctggatatcttcgagttcgtctgccggctcgggtctccattcctctacatcccgcatatcaagctctactaaattgatcggtttccgaggtggttgttcctcggtcttggatcccctttgctctccttgccgaattcgaggtggtgatgacggaccgccctccgtttttctgatcgcgttgtaataacactgccgggactctttctgatctccgcaaatcgtgatgactctgccgaggtgtcccaccatcttcattttctgatgctttgtggacatcaggatatcccacttatgaagcgtgggtcttcccaggataatgttgtatggtgacgggaactctccgacggtaaacgtcaccttctccgacctgaagccttctcttgttcctaatgttagctggaggtcgatcaccccttttaggccggtaccttcaccgttgaagccatacagcattgtttggcacgacctcaggtcttcctccttcaagtttagcttctcgaaagcgctccagttgataatgtcagctgaactgccgttgtcaacgaatatccgcttaactcggaaattagcgactgtcccggttatgacgagaccgtcttcatgtccgggcacaacgcccttcaaatcttcgtcagtaaagtagatcagcggaggtgtgtctttcttgctgtctccgccatcggtttgtttgaactttggccggtctcttaccgacatgacttccttaaggtacttcttccgctgatttgccgtatcgcctcctcctcctggtcctcctgcgatgacattgcattcgaactcgggttctgggaactcgtcatccttcttacttttcttgtcctcccgtggtttattttcctgttgaactttcctcttggcttggtgtccctgggttcgaattacgtattggcgcagcttgccttcacgcacgaacctttctatagcgtctcgaagttcccagcactggtcggtcgtatgtcccgggccattgtgaaaatcacaatatcgggtataatccatcccttccttccgtaccactggaggaggtcgggtcacttttctcatctccgtgaaggccacctccttccaaatttgtccccggctagcgctcaatggagtgtatctttcaaacttcgattcatatttccccgatctaggccggttgtcggagaatcctcgtggaggtcggcctgctgggaggggagttggatgtcgactgttttgtccgacttggatgttctcgggtcgtcggtttcgcggtgacgtcggttttttgttatctcttggagccaagttggcaatctccatctgctccagctccagatattttttggatcggatgccgaattcgttgagggacttaaccgggtctttgtatatcgacttggcaagtcgggaggatccgttgagcccggcagacaagagatagacatggacgttctcttccagcccatggacctgcagtgcggcttctctaaatcgatccaaatagctttgcagcgtttccccgttctgttgacgtatccttcccagagcgaactcggatttcggctgcttcttgcttgttgcaaagttgagcaagaatttctggccaaaatcttcaaaattgcggatggacctgggtggcagtgagtggaaccaagtctgggcggcaccggttaaggtcgtcgcgaaaatccgagatataatgggttcatcgatccctcggacacacatttgcatatcgaactcgtcgatatgtacctgtggatcctgactcccattgtacttatttagaaaagacccatcaaagtcttccaaaaatggggcgttcactatgtggtcgacgaacgggctgttattttggtggccccggctatattttctcctatatatgccagtgccttgtccgggatggcgggcgacctctcccatcggtctctcccccgcggtgtgtgaaatggccgtggatgaatgaacctcgtgctgtggacgaggtgtttttccttgttcggaatggtcggcaggctctggttggtcggttcttgctgctcgggtcgacatcgatggtcccgaccttcttgctgttgcatggtcggcctctgggcgacttccgtcgtgtctatcgccggtattttgccgacgctctgccgcgcgtcttctgtcgtcacgatcctccaactgagcgatcagctgttggatgtcttcctggcgttgtaactcgtagcgcttctccaagttctccattcgggccaacagggattggagagcgctctggatgaagcgttgagaattctcttggtcggccggtggtatgttggccggctcctgcgtcgtaggttccgcacgagatgatgccgtgtgggatgacgcgtcttctgccaccacctcctccggagtcggattcctgggtgggtcttcacgtctggaattcggatttcttctaccgttagccattgatagatggtgggaatcgaattttatcgttcccacagacggcgccactgttctgctcggtgagaacagagatgtccaacaatggagttgggcaaattaatgtaggatcaaactctctctctctcaagaagcttatggagacgaagccacttgaggaagaagatcaccgcacgatgaacacgacactttggggggtgcggtgtgtacaggtgtgaaggaaaagagagagttagaattgtgtgtacctttcaccatgaattgccgatatttataggatacctggagtttgttcatcaaacggttgcgcacgattcctatatatgtggagacactggctcgtgggggataacggccacccccatatttcagggtggttatcgcgggctaacagaggttgtttgactgtttcaaacaagataatacgtttccgtaacaaccagatttttgtctcccaaagttttgagctttttgatatttattgtgtacgtgttgattttttctcatgggtgtcaagttacgagtttgtttcttgcataaacgttgtttctataccattttactcgcaattttgagtcccatttgggagactaaaagacctaagattttggttttgaaaatcagattacattttttatgacgatttgtgattatatttgaaattgcagtttcaaggaaattattgtaccattgatcggtaatatttgtaatctggccttgttttctatgttcagatatgtgatgggtggtggtggctcagccgccgcatctgtggatgtggaatagggaaaaaggaggaaagggaggggttgccgaaaattgctttctgcgtaggtgtcgttgtcggatacaagaaaaatggaagaaaaggaataaatcggcaatggtgatgaataagccagagggataaatcgcagtcaagaagaaaaggaaaaaattataaagaaaaaaactcatccatgggattaaaatttaataaatctaatggtggaaattcactttccattgtggaagacctattatattctcccacgctagtggattaattgtacattatgaaacatttaatactaaaaataatattcaacgaaattatagagtctaaatgtatattttattcaaaatatttcaaatcttgctttgaattagttgttgacactttacaccttgtttcatactaaattgtgcaagatgtaactatatatataggatttaggatttaaatcatggataataagaaccctaaatcctaaattataaaccacatggaaagaaaaagactttgacatggtgtatgtgtagtttacggaaaagataatatggattaattatagtatgtttgaattttggctttaaaattatcatgaaatatggtgagataagtcaaatttaattttatctaaaactagataaatggctcatgactccacctgtagtaattttacaatttataattttttataatattataattttttatgtatttaattattatattttaattaataaaatatattattattaatatgttagtatttaagttaacatttttttattatcattataataaattataatggtggaaattcatccatgggattaaaatttgataaatctaatagtgaaaattcactttatcattagtgggagacctattacgctctcccacgctagtctctgtcagattagggattgaattgtacattatgaaagatttaagactaaaaataatattcaacgaaagtacagagtctaaacatatattttacccaaaaatatttcaaatcttgctttgaattagtatttgacatttaacaccgtgtttcatactaaattatcccacatgcaagaggtaactatatatataagatttaggatttaggatttaaatcaaggctaataagaaccctaaatcctaaattataaaccacatggaaagaaaaagactttaacatggtgtatgtgtagtttatggaaaagataatatggattaattatagtgtgtttggattttggctttatgaatgaacataagatgagtcaaagttgattttatctaaaactagttaaatggttcataacttacaccacaataattttacaatttataattttttttataatattataactttttaagataacatttttattattattatcattataataaatatttatgacaatttaataaaaccatgataataaaaaaattaccataattattacaaaaacatattagtgctaattaaattataatccatattatctcatgcatcaattattttttgactacaaaaatatccctaattaaataagagaaaaatcatattaacatatatatttagaagagagagcaacattaatgataatagtatttttgaaaacatattattttagaacaaatttataattatcaacttaattaattatttttttaatattgataaattagataattgagtcttataaatagaaatagaggtaatataatatagtagatagtagattttgcatgtttagttattttagcataatcaattttaattgaaaaaaattatatatgatggagttgaagtaggaataacttctacttctaccaaaataaatcgtagttatattttgtttaatttactttcacataaatactctcatatgcatatgtttgtttttatttatttgtttaaaaacataattaaaattcttgctatatttatagattctagttgttatattttttttattgaatgcattttatctaatttatccttgtactcataaccataatattgtgataaatcattttaaaaaaatgaaatattatatttcagtttaattattggtacatttgggtttaattctatatatatatannnnnnnnnnnnnnnnnnnnnnnnnnnnnnnnnnnnnnnnnnnnnnnnnnnnnnnnnnnnnnnnnnnnnnatatatatatatatatgaaaataactaattgttatagaaaatcagtgtatatagacattcaaattcattttgatcattacaccatcaaaatcaatttaatacaaacctatagtgcaaatcaattctaaccataattatgtaaaatcattttggtgcaaatcgacattgattagtttttcatctccttcaatcatcttcttgccttaacttgaaccatctacctatagtgctcttaatttcttacaaatctccaatttctccgcgctaccatgaagttgttggagagcaacaacaaacaagtgtcaattacaaacattggcaaaccgcaaacctatacaaaagcagaaaaagaactgaacaaaaacatttttcttgaatgaatcaacagcttaatattacaagatctcaaattaaatatccatccaagagcttattttgaaacttttatacattatgatgcccgagtaaatccataaaattaagcttttcacaaccattaaatccattcacaaatcatggctacatctttgaaaattggattacctgttttttcaattgtatgtgcctgtttgctcttctattttctccgtatagactacgaatgttacagtagaacatgagtagcaatatagagaaaaataaatgcaaactaactaattggtaggataaaacaaaacaagagagatcaaatttaaggtattgtgtttgtttgaggaagatattcgcacacgagtttgaaaccagtattagaaaaaccatcttcaaattggacaattcaactactgaactgctcaaataacatgtctgaatgtctcatcagtaggctactggatcgatttgcaattggttagtagactatcttttagtttctctctgatcacaaactcttttttagcttagcgaaacttgaaactaattcttttaaactaattttggtttagtttggttcacaggaacaatttggtgcaatctctctgctttcgattcaaagctcaagtatagaatcaaagcccaaagcccaagtatatgcacttgtgtgaattttccatgcctttctttaatttgctgacataaggggattagagcttatcattagcaaaaaagggtttatcgtccgaggaattgaagtttagctaaataagagaaattgaatcacataattaagacgaccaagagattatcttagggtggaatcaagggaatttcaacacctaactatttttattaattgatttttctagtacattcaattgtgctaatgtttctttcaatcaaattaaaaaaagtctaaaaattcctaattgtttatctcttaaatcaaaagagtaatcgataatttgattgattgtatatttgataaaccaaatttttcattgatacaataatttgtccttattttatcaattgtacaactagtacacttttcgtattctaaccaaactccaacaatatactggtaaaaggtgactcagttgatctttaagtcaatttaatttccatataactaaacgtgatgggaataaagtacgtagaaccgtagaaatatagatgacacaatttgtttgatgttaattaatgtaaatgtactttctcttgatattcaataaatatgcatgttgtcatcgttaaaaaataaaaagataagctattttttagtttctaaattttttaaatttatctttttagtctttgaattttttatttatatttttcatctcttattaaattggatgatgcattcctgtgtttatcactttattcgatctaaattcctctatggatatattaatgaaaaaagaggtccttgactgcttgggcaagtcctcgcgagggaactttatttgttgaagtatgtattacatttttgtttgcttggaactataataacagatccgtagagagagtctcacaattgatttttaaggcagcatggcacttcgatcaccaaaggttcattccattgatagagtcatcacaccctcaaatacactctttttatcccactctctttcattgctccatctcatcttattttttaacttcgtcctcattgatcctcactcaacctctttgccaatgaataaaataaaggggcaagttacttgaaaggcatagggatagactgtttttggttcttaaacatataaataataaaataaaataaaaacttattaagtgtcataacctgaattttagttttagacattttagtaatgattgtgtaatcttattgaattgattattggcaggctaggatttaagaaaattatgcaagctgacgaggatgtagggaagattgcaatggctgtgcctcttctagtttgtaagtagtctttctctttcatgcatattctagggtgttttcttcttctcttgaaaaatgattttttattttattttatttattgcgcttttggaagtttctatgaattatctctgattaataattatttgtgtttatgtattgcagctaaagcactagagctatttctgcaagattattgtgatcgaacatatgagataactttgaggaggggggcaaagactatgaatgcttttcatttgtaagtgaagtttctattattttctttgttcaaatttttgtctatgtcaagtctgttcaaggtggttacaaggctgcaggtttctttcttttggagggcggttattactatgtacttataagaacatcagatctgcaattctaatgatgatgtgctcagtctcaaacaatttccctcttgtgccttctatttatcacatgcacaaacatgattagacatgtaaatgacatctgcagaagcaaatgttgggatggtcttgcttttggaacatgtgctgtttgttctagtgtttacgtccactttccagtttctaaaatgtctgagttacttgcatcctaacctttgctgaaaacagtgtgtgcagacttttaatgtctttgattttctgaaagatattgtcagcaaggttcctgatttaggctgttctgttgcaactggtgatgaccatgctgtcactaagaggaggtttgtgctctggttaagactcttgttacttggaacaagttttctgtatgctgaactttgtttactttatattaggaaagtttccggagatgatgataatgacagcgatgaggagctcaagagaaaaaagaaggtaatttatcaactgtattcaattacttcatcagtggttagcttaaatttttcttgtgtgattaaaccttttgctgagtaattatctcttgttcatgcacactgtgaaccttttgctggatacaaaaaattttacttcagtcaatagggaaactcgctagtggcttgtgaatgcaagtacgtctaaatgtctaatagtctgtgaggctaggccccacttcaccttaaagctactacacaaaggaccaaaactgtctggttttctgaaaagtgaaaactatacaattggcactaaagaaccttgcagctgtttaatattaaatattatctgaattatggaactttttttttccatgatttgcacagccagagcctggacataacagtggcagaggaaggggtaggggcagaggtaggggtaggggccgtggaattagaactgtacatcaagaggtgagttcacatgccaagtgggaagatgattctgatgaattgaagcagaatgacaactacactcaaagcaataaaaacatggaaaatgtgccagaacctgaagtagttaagcaaagttttccagtgagcaaaccggctgaagtgtccattcgaaattttgacttaaatttggacccagatgaggacatgtagattgttccaatcaatgttgttaaaacttagtgtcaacttagaaacggtgaggatgaacaaaaacgtaaaaacgtgaaatgtaaacaaaacgtaagagtttactacatatacaaaaataaataaatatctaacatatatataacaaatagtctaataaatatatcccctttaataaaagttagtaaatagtaaatatcatattaatagacttcttaataaattaaaagaataaaaaaacattaacaatcaatacatttaaaaagtgattctaattaatttcttaagacatcttatctaaaacttttgccataatactttaatgagtaattatttaaatctaaaataacaatgtagtacataagcatgtcaattattatcctcaaagagacaaaaataacagtgccaagtgaacgactaggctaggctaggctagatgttgtgtgtggtggggaatcaccagggcccagcttctcttctaagatccgaatgtccctccaagaagttcctgttccagcttctcctcttcgtgggtgtcaccggcgccgtcggtcaggagttcctcttcgtcctctccaatcgcaacttcccctatagctccatcaaaatgcttgcgtccaagcgctctactgggcgccgcatcaccttcgaggacgtggaggagctgacaacggagagcttcgacgacgtcgacattgcgctcttcagcgtcggtggctccatcagcaagcgcttcggccccatcgccgtcgattggggaacgatggttgtcgacaacagcttaccgaagtgaacccggaagcaatgcaaaaaactgagtcaactcggtaaactcttcgagtcaaccgagtttaccgagttgactcgccgtttcaaccaagtcagcccattttccatttcaactaccatttcaacacaatttttgaagcaaaaatgtataaatgtctatttctaccgagttgaaacgacgttttaacaacagcagttccaattagaaatagccacttgcaagtatagttatgacttatgagaaattttaatctcatgtaggtattgcttatggtaggcactacattcagattttgggggtgttatggctcaaaattttaggggatgcctatcttaatcacacttgtatctaccggaattaactcattgctccggcaacatgatttgcatgcaaccttttgaaattttgttatctcttgaacttattgcacgatgaaacaagaggaaaacaataagacgttagacggatagaaataaatacgaaataaagtaaaaaagatgtgttatttagatgaataaaaataggaaggaaataagtgtagaaattcattatttatgtttgttttgaacaaaagaaagagaaaatacaaacaaatgaattatttgaaaaaaaattatacatttttaaaaatgatttccattatttttctaaaataagattattattttttttactatataatatacttgatttttaatatataagcagcactgatggctgctctgcaaaaccaatcttgcctcaaactagtttgtttaagcttaaaataagtaattttaaaataaatattttttaataagcccttatttcataaacaaataacgttatcaaaataagcagaaaattattttttaagcataaacacaatttagacaaatacactaaaaaagaaatcagataaatggaaaagaaacaagagggatagaaataaaagtttaatatctgtatataaaacagttttaggcttttacaaattatcattcactcataacttactagtttaaaagataacaaatttatcatacatacacatggaaggaaggggaaaagctttgacgtgggttatgcagtatagtctcaaattaaggcgagaacaataagaaaggtaatatttcatgacagaaaatgtagaataatctcaaatttaaacacaagcttgattgttccacaaacaaataataatacagtgtcttaaagttatgccaatgtctgtaactctatagtaacgtagtcctgtttggacaaacgataatatctagaccagaagcgtttgtctaaaaacttaaattgaaagataagaaacagaagtattgggaaaacccccattgaagccactgcataagaaacccacttggaagtgtgatcaaatatcaaaaaggaggctgcagtgaaagccacaaccatagcagcaacggagataataagtaaccaacgcccaatagtcaagctgggatgtagtgatttcacaaattcgctatgtgcgaatcttgatgaagtgaaatttgacaagaatgagagtaaagaggcagaagaagtgaataatgcaactgcatttgtcaatatgaagacagtaaaccgtgcattggtcttatcacctggaatagtgagagcagccgcaaatgctacggtagcaacaagtgttgacacaagcatgccagattcggctattcctttggctgtttccttaatttcttcagataacttcttgtgttcatcataaaatacatcaattggtctcttgttcatgttgtttctcattgttcttagttcaccaggaacattactctccacgaactattaacaaatcaagagtatatgtaaatgatggtatcgaaatgcataagttaattaatctttcaattatcacttaataaccagagcaaattaaagcaacagctcctaagatttagtgtaattacacaaacatttcttcaggtattagaataaggtttgaggagatgttaacttaatgctttcaagcatataagagatgttagtgtaatttttttaatttttttaaaaaatagtgtaggaaaataataaaattaatggaattacatataattacacaaaacctatcggaaattattgtaatttgctctaataagtattagatattaaatttgtaagaaacagaatttcaaagataagatattttaaaaataaatcttaggagtgatatttattgttacaaatgcacttgtataatttttaattaaaattttctatctatatattggctgtttaactatcatgctaaagacaatggataacaaattttaaaaaattgttacaataatcaacaaatacaaccaatgatttctatttttaattaaaatttgttactttaaatatttaaaatcagtctagttaacaaaagcctaaaattagtggaattttaaatttttaaaataagattgctagaactgatggatcccatgcgagtgaataaagaatggttgaacaagaaaaactaagcaaattaattgaccttgaaccattcgagctctctttgaatttgaatgcttgctcttaaactggataatttttcgaattcaccttgtggaagatgcgcagccaagtgtagaatgttgttaccatcattgtccactgttcgtagtagatgctctattaatccccgtggtatacgtatactattaaatattttttttgtcgaaatagcacaaccaagtgcagtaggttccgtccatggggcccgtcctttattgtcactagtttacgattcatgtcaataagcatattcacagcatcaacatttcccgattctattgcatcaaacagcactgacgatggatgagttatcaactccattatccgcttatgttccaatttgttaacttgagtcaataaattttcaaatagccgaccagctacttctgatttcttgtcgtccttcccgtttatcatgaggcctatatatagttgattggtccaaccaatgtttaacatgaaatgaaacaaacaaaagttaattaaattaaaattttactcttatatatatgaagcaccattttttatctctatttcaaaaattatatttatattttaatccttacctgaaaaaaaattataagatatttttgcacatgtgactcatgtgttggcaaacattaatttgtgttattagaataactcaacaacaaacatctaataccattattacactggatattgataattaaggactaattcttaatattatatatatatatatatatatatatatatatctttctaaaataagaatcaaaatggaaatgatgtcaaataagatctaaattttagcttagcacacacaaaaaagaaaaaagaagccattttcaacttgtgaaagcttacctaaaatttctagaggcttttgcgccagcatatgcaatgctgtaaggtggtcctcttcatttcttgcaatggccagagcagttggatgtttttcaaataatcgcattgccaaatctgttatacgcacaaattaaatagtacaaggcaaggtaaaactccaactaaattgaaaaaccacatacgagttcatatacatctccttatatatatatatatatatatatatatatatatatatatatatatatatattatggtatctgatcggctcaatgagttcgattcagtttgtaaaacatcatgatatgtaaaagagaactagattaaaaaaaaggataaataaggttgtttagttagttttacacttaccaaacatgttgaacctaacggttattaaaaacagtcgttcaatatccttgaaatccattatgtcaagcactttgttagaggacaaaatgtccaccattctgtcggaaccacgtaaagcagccaagtgaagtggaagcatcccatctgagtttggtattagcatgtcttctggcctcatacgcttaaccaactctttcacaatttcaaggctggcccaatgtactgctagatgaagagctgtctctccactaacatttaacggaaagcgtttcatatcaggacatttatcaaaaatccttattaaagaacctgcaatcctttcaaacttcacattataaaatgtcctctttatataataatcataacttttagtatttagctgcaaagaagacccttttaatttctcgtttaccctaaatcggtataaaaattcttgtaaacttgtctcaaattttgaattcctaatagtttcatcatttgtaaattgaaatgtacctgagaaattcgagattatatatgtagtagtagaaggaatccaattatcaatcacctttaattaagtttgaaatttgaatttgaatttgtgtttgaaaattaactctatgatgataagtaaaattgtttttgagagaagtaatttattttttcttttcttcagttgacaaaaaagcaaattgatcttaacatgtgacttatacttatttatatcatactttaaaagccattctactttttttatctttccaataaaaaaaataatttctaaacccattgttgaaatatcattcgtataataatagtataaatattttttttttttaacgtcaagcggtttcaaattcaattttttcaaaatgtaaaataaacaaactcttaagacatgatctctgaactgcactctcttgtgaatgcaatagtttcaagtgtaacttactctgctcttctggagtcatttcgttcactcctctactctcatttgttggtgccggtgagtttgttgaagtggcaattggagtttgctcatgactttgattaggagtatgatctagtgttggtataatctgaattatgtggtcatctgaaacttcgatattggagttcatgattcaattctagacaaaatgaaatgaattggatacctctatgaaattccctgttcgattcgatcagcgttgctttttctttccagcctgcgaagcttgaaccatgttatatatggtggtaaaacaagagcccttaattaattagttttccaacttgcacttaaaataattatttccaatatgacattttgtggattacagcaatgttaattgaatctgctcaacatttcaacccaacagttttcaaaagtttttaagttgaatgatttctaaatttatataatattaattcatttttaaagtgaataaatatgttcattaaattttttaacagaaaaaaaaatattcattataaaaaaaattatattcattaaattctctggattagcgagactcgctatcatgacactgttaattaacttaatctcaatttaatattatctttctttgttgtacaatgatatgatatatttacacacttaaaaccttcaagttcctacctactcttgtattgttgacgaaccatagcgatggttatatatttatccaacttccgttgacgcatttaattatatgattatatcctaactctggtctttttatactagttataatcaattactccaacaaccattgaattcaaagctaatactagatgcatgttattatcggaatatgtataaatttattaaactcactccaacaaccattgaattcaatgttaattcatttttattatatcctgactctggtctttttatattggttaaggatattttgattcaatatatttaatagttacgttgctaattatcattatgatatttttttgtcaaatatgttattttattgacggtataaaagtcaacgaattgatggatttattgtatttttttatttttattgactaaaatttaaattttcatttataaaaaaaatgaataaacgaattttcagcattctacacataaaaaataattattatttatccaacacatttttataaaatttaggaagacatgggctatgatgggagaggataatcgatctcttaccgtgaaaaagtattttataaccatcagactactttgtcttcctgtttcttgtactacctttttcctcttttttcttctcttctttcccattcttccactccaagattgatcctgaaaattctttagttcggggcgaaatgaaaaaaataggtccctaacacataaattttttgaaatacaaataatattaaaactaggagatggaaaaaataggcccttaacatacaaattttttgaaatacaaattatattaaaactaaggaatggaaaaaatgggtctctaacacacaaaaaataggtccctaacacacaaaaaatgggccctaacacacaaattttttgaaatacaaataatattaaaactaagggatggaaaaaatgggtccctgacacataaattttttgaaatacaaaaaatattaaaactaagggatgaaaaaaatggatctttaatacacaaattttttgaaatacaaataatattaaaactaagagatggaaaaaatggcccctaacacacaaaatagaccccttaacgcaggtttcattttttttttttttaaattacttaagctatcggtgtaaaaaaatttgggccctgggctggcaccccgttcgccttgccccagggtcgaccctattcctcttttcgtcttagcgacaacggtggtgcatgacggccggtgatattggggatgttgatgcgtcattctaccacaatatttcaaccggagaaaaagcatggaagacgaaacagtcataaagcttgatataactattgtctcacttaaacccaaattggattcaattgaacaaaccagattttaatctcccaaagttttgagcttttttatatttgttgtgtacgtgttgattttttctcaagggtgccaagttacgagtttgtttcttgcataaatgttgtttctataccatttcactctcaaatttgagtccaatttgggagaataaaaaatctaagattttggttttgaaaatcagatgaaattttttatatctggccttgttttctatgtttagatatgtgatgggtggtggtgtgttgcgactattccgcacactacggcaagtgcaccgatcgtttcaagtaataaactaggtaagtgagtatcgttctccacaaggattggggtgaagttcacagtaataaggagtcaatgtgattgaaaataaaaacagaaaatgttggaagaaaatagttggattgattggttgagtaaaacagaaattaaaatcaatagtaaattaaattaagaagttaccaatggaaaaacaattgtggtcaggcgcaatctcctttgattcctccctccttcacttgactggtttattactttaatttactcaaatgataaatctctcataatttcgtaaatcctaatttattagcgacttatccctttaattcgatcgagaattctaatcccttagcaatcctgtcaaactaagcatttagagaatatatcataagggttcctgttatgattgttcagagaataaatcttttctaaattagttaatccctaatcccttagtgaattaaccctttaacctgaatcgaaaacctaattccttagtgaaatctatcagtttaagcatttaaaagaccatattataatttctgcagctacgcatccctatccctaggtgataaacaactgttattctaaacaggtcagaaattagaatcccaacgtccccattgcgaatcctaaccctagatacttaattgaagtgatcagttccaaataagaatggaaaataagaatagaatagaataaaacaatcaaaacattattattcaataccagtcaaattacagaggagttcacatcagttcatggccttcccacaatacaagatttagcatgccataggcctcaagaacatcagagcagtagaataatacatgactgtgctgaaaccctagccttgattcttgatttccagaggtttagaatgatgtttacaatgtaaaagatgatatccagatgtccttttctcagttcagaggcctttcttttatagatagatttaattagagtaataagacctaaaactgtgctcaaattcgaaacagataatttatttaaggaaacagaatccttgtggcgcgatccgcgcggagtctcgcgctaaccgcgccgcctgttcgaacacatggccctgatcgcgtggagtcttcgagaatgaaggtctgatgctgagcttgtggcgctgatcgcgtggatgtggcgcgatctgcgtgggttattcgagttaaatggcctggcctcatgtccttggcgcggcttcggcgctgatggcgcggtgcttgcggccttttcacgctaatcgcgtgaactcccacgctgatcgcgtgggatcttcgagaatggggccttcaattcttcacctggcgcgatccgcaccggacttgaaatcttgttttcttctccttttgccttgaacttcctctttttaacctgaaattgctcaattggtaatgaattgaatttaaaacaaataaaatgataaactaactattcttattctattttcctaattatttaactaaattatatcctaaaactagcctaaaactaggatgtgtttgcaacacatcaaacaattcccagatttgaaatttgctgtccccagcaacagaaagaattcaagactaagcaagagtcaataatcaaacacaaaccacaggttacaatcctagaatcatcgtgctgtgtatgatcaaattcaaatcaaaactttcaatggtactttcaatgctgtcaatcaatgagagcaacttgagtattcctcacagaattatgtttaatcactcattcactcaagtgtatcaggctatgattactctcttactcaacaaagtcacagcactaccataagcttgaaaatattatcaacagttgcaagcacgacttgatcaaaaggtctttcaggcttgtaacgtggctgggctaagggtaggaaattatttggaaaagtagcttaatgagaggctagatccagtcccttaagtccaatccttgtgatcttccatgcttcaaaacctggtacttttattcaaactatttattccaagtaaaataaaaacagaagaataactttctcttttttgttttttttttgttttttaataaaacaatcagattaaagtaaaacataaacaaaattgaaaattactgcagcttcacaaatctccaactgatggacttattgttctccaacttggactatgcttgttcattcttgttcttcacaaccaattggattcacttgtgttccttgataccttgatggataattccctgtttttccactgtcatggacttatatcaaaccttttctagcctcaggaatttggtcaagtggatatagttctgatttgggtcattttgaaatgaaaggcttaggctcaaataaggtgcaaatggaaaataattgaaggtgagtcaatttggccctagtttcagaagaaaaatctgtcttaatcatatcaagtcacacctgcatccagagaaacaattcaagttctagagtaccatgaaaatggagtctctcggaagaaaatttatcattgttggctcaaaacctcacaggtgttagaacccaagtcaatctcagctgactgcatttcaagcatcatttcaacttcaacatgcatttctcataccaacaatcaaattccattcatgcatcatgcaggtcatgctatgtctcatttcatcaagcttttatcaaagaactctatccattactgtgtccattcacttttattctgaaaaatctgatgtgatgcttatttttgaaattttttttgaaaaattctgtttctgttagacgtcatctgttccttgattgtgatttgcgaaataatgcgtaccgaccattcccaaatttatatgttgctgtccccagcaaccacaaataaggtcacaacgctttggaaaatttcagcattatttagaaaatcgcattcaactcaacattgatctaaacagcttttatttgcaaacatgaatcagaaactgtactatatatataaatgcagtaatgtaaatgtgcagaatgcaatgtctaatgcataatcataactaagacataaaaccagaaacatataaaataaacataaaatagaaactgaaaatatgatcctgttcactcctctccctctctactctctacaatcactgcagcatctgtggatgtaggctcctgagtggatggctctatagctgctgcatctgcatctgagggaacatgagggtctctgtggctagaggtgtggtatctgctggtgtaggagggtctgaagctgcaactggtggtggtggaatttgatactctgctggaggaatgcctaaatgtctacgtatggctcctagcatactggtctgctgagccagctgggtccggacgaactcctggaaggccagataaatgggagaatctgtgtagagcggctcatgtccaagagtggtggaagaaggagttgaaactggtggtgcatatgctggtggctggactggctggggctcctcaggtgctggtacatctctggggctgcgggctgctaactcctcaggtttgagcttagaagctcggagaacctgctcatcagctgcggtcgccatggcgtccaaataggtcttgtggaccataagaggtgcgatcgggacgtccatgggctagtcatcatcaatgtgcacacccgcatgtcggcataaatgtagaataagggaggagtgcgccagccaggatttgttgctagcgtcttgtatcatgtgaagaatcctgttagagaggaggttagagataaggaggttaccatcacctctaagggtataaaggaagacagccctctcgacgttcacatcagtcatattagtagaaggtatgactgtgtgattcacgaactgatgccagaaagcggcatcgcccactaagtcgtgcttccgcagcttctctggtatataatccagcccaggcttgggcttccaagctgtataaaggccggtgatggccctgcggatagtagtggcaagatgaggaacatcgtccctgtacatcttcgtcagggcgtcgggctgcatcctcaggaatagatggatgaaatcacagtcatcgaagggatcatagcgagtgtccaagatgctctcaatcgccttctcatcaaaggaaacttggacacccctcacccatgagagtctgctacgtgccactgtatcgggatcaacattagccaagaattccttcagaatcatgctggaactgggctccggaaaactgactaagcgctgccactgtcgtctgagtatgacctcacgaactgggttcccctctggtagtacatcccacagaatcttcttctcggggatgactttcttcaggagataccaggtgtcaaacttctcctggcactcaggggatctgaatctaccctcatcataatccgcaattcgagccctcttgctgccacctgctcctgtggccttctttttgcccttggctacctatttaccctgtaactcagaacaaaagtagatatagatgcataattcaattgattcaatccccagatttgctctttgccatagttcagattaaacaatcaattaataagtaactcaggcactatgcatcagtgagtgatatccagaaaattcaaggtgtaattcaaatccagcatcaataacattgttaatcagtttaagtttccagccaatattgtcaacaacaggcacactcaaatgggttcaattcagtttaagcaaaataagggtccttcattcccagatttaatgatctcacctacttatcaaaacaaaactcaggtatttcaagcaagcaccacttcaattatcaatttggacagtaactacatgcacattctgtcacatagtaaatggtggcatttggattcccagatttgactacttgagagttctcaattcatttaaacactagttgatatagtgcagtcaaaaacagatctatgagtttaagtgaccatagtcaaagcatttacattattatgctcaattcatgccaacacaactataaagcaatcatatacaacctaagcattttggttacttgcatattcagtcaatcaccgggttaaacaaattctattcctaacctgagactagcccttacaattcccagatttagcttagcacaagttgctaaagatggacatttaatttaagtgcatcatggatacagtctagcaaagtcagtaatcactcatcaaacagataaatacaaaccattgtccctgttttggttcaaaggttttgccatgcttagtcattcccagattttatgtgattagttgtgcaaagcttactcaagaaccttttatagccagccaaattcaattaatcaacagatcacagtgtgaagtttaatgtatccaccacaattgaattccttcatctagctcataatctgtcaagcattataacttatcatgcatttcatatcaatggttgacagatcaaggtaacttatttcaattcaaggttacactatcattcatactttacccaaattttattgccacacccaatcaaaacaacataatgcagctctcttatgcaacatcatcaattcatctctcaagggttttaagttccctatcattgacagcttcagaacaagcaacatatctaatgttctgttaacacaagaaccttaagcacaatttatggacaacaaagtcatacctgcataactggaatcaaacaaatgtgtctgggccttattcatatcacaacattcaaattgttgaaaggctcaatgcattttaccatagttcagttcaattctcattcaggcattttagcaaacatctaatgggcatataatcatgtcaacacactatgcctattttgaactcatcaatatcccaaatgatcaaaaccatgacaagcaagcaaaatgcaaagcatttgggtctctaccctaaggtttttcccaaaattccatcagaagtaatgtgaagatattaagcagtgatagttgagtttctaccggtcatggttataccattacacatttcaaagcacataagatttagaaaataccttgtcaccagccattgtgcgagtgcaagcttttggtccctactggtgcaaatgcagcagaaacttagagtggagagggaatgagaatatgagggaatgcgcaagtgagacagacaagggtgacagagagtgtaggtcaggctttaaagagtgggagtggtgaggaatgtggttacgggtggttaatggtgatggctgggttgcaggcggaaagagtggagcagttttggggggtgaggaattgaagcgtgaatgggaaaatttaaaataaaaaccagttctgcgacgtcgcgcggttagcgcggatcctggcgcgaatcgcgccgctatgcactggaaaggttttggtttcggcctccccgcgcagatagcgcggagtgtcatgcgattcgcgcggagtccacatttggcttcaattgatgctgtttaaccgcgctgatagcgccatttccacgctatccgcatgaactggagttggagggtccttcagcctcgaataactggcgctgacggcgccatgatccacacgattagcgtgggatcttaagtcccaggcttttggtccgaattcttggcgctgaccgcgccattggccacgcgagtagcgcgaaattatgcagaattcaggcttggtttcgaacgtctcacgcggctagcgcgagtggccacgcgatccgcgtggattggccgtgtttacggcgctggtagcgccacgcctggcgcgagtcgcgccataccttctgattattcttcctcttctttttatttttgctttttaattgctacccctaactaaagttaataggcttaataaaatgactataattaaataaaactaatctaatgctaaggctatcaaaatctagaaaggaattaaactatctaatgatgcatgagattaatagtagcatgaaatatgcagtggaacaactactgctatcaaattcaaagcatacttaaacagaacttaaaatagcaagtatgtacattaaaattgtgctcgtttaacgtcttaagctagacgcttacttccatttaaacctcagtggcgttgagtggaacagaacttgagtttctgtcgacatctcccccaaaataatgtttcagtctatacccgtttaccttgaaagctcggtcactatccaagggtgagattgccactgtgccatagggatagacttctcgtatgaggaatggtccagaccaacgtgatttcaacttacctgggaagagtcgcaggtgagagttatataacagcacttgttggccaggaacaaactcctttggacggatttgattatcatgccacttctttgtcttttctttgtagattctggcattctcatatgcgactaacctgaactcatctaattcatttaactggagcaacctcttttcattagcttttgttagttcaaaatttaaaaacttggttgcccaaatggctttatgttcaagttcaatagggagatagcaagccttaccatagacaagctgaaaaggagacatacctatgggggttttaaatgcagttctgtaagcccataaagcatcatccagcttcttagaccagtcctttcttgattttccaacagttttctcatgtattctcttcaattctcggttggaaatctctacctggccacttgtttgagggtgatatggggttgccactttatgcttgactccatatttagctaacaagctatctagctgcttgttgcagaagtgagtccctccatcattgatgatcgctctcggcaccccaaatctggtgaatatgttctttcttaagaatgagaccaccaccttggcatcattggtgggtaaagcagctgcctcaacccacttggagacataatcaacagcaaccaagatgtattggttggagaatgatttagggaaaggtcccatgaaatcaataccccacacatcgaacagctccacttcttggatgttgtttagtggcatctcatctttgcgagaaacattgcctgttctctgacaattatcacactgcagcacaaaattcttggaatccttgaataatgttggccagtaatagccacattgcagcactttgtgtgcagtccgatttgctccgaaatggcctccatagttggaggaatgacagtgccacagaatatccggcacgtcgctttcagctacacatctgcggataacattgtcagtgcattgaaaatacaagtaagggttatcctagaaataccttctcgcatcatgcaagaatttcttcctctgctgccaattgaaatcttcaggcataatcccagcagctttgtaattggccatgttggcgaaccatggctgaattgcacagctaacacttgctcatcagggaaggactcattgatttcaacttctggtccatcttgcaagtctttctcttgaatcctagacaagtggtctgcaactttattttctactccagctttgtctctaatttccaagtcaaattcctacagcaataacatccaacgcagcaagcgtggttttgcatcttgcttatgcagcagaaattttaaagctgcatggtcagtataaacaattacttttgaccctactaagtatgacttgaacttatctaagacatatattacagctagcatctctttctcagttgtggcataatttatttgtgcttcattcaatagtttactagcgtaataaataacatgcaagcacttttctttcctctatcctaaaactgcacctactgcataatcactagcatcacacattaattcaaaaggtaaattccaatccggagctattaaaacaggtgcagtgaaagtgttgaatgcactaagacaagcatcatcaaatgtgaactcagtgtgtttctccagcatttggcttaatggctttgagatctttgagaaatccttgatgaatcttcggtaaaaacctgcatggcctaagaagctgcgaacaccactgacattaatagggggaggtaatttctcaattaataacaattaagccctatctacctctattcccatttcagatattttgtggcctagcactatgccttcccttaccatgaaatgacatttttcccagttcaatactaaattagtctcttgacatcttttcagaactttggctaagttagttaaacatgaattaaagcaagggccaaaaacagaaaaatcatccataaatacctcaagccctctttctaccatgtcagagaaaattgaaagcatgcatctctggaaggttgcaggtgcattacaaacccaaatggcattcttctgtaggcgaacaccccaaatggacaagtaaaagcggtcttctcttgatcttccggtgccactggggtttggttacacccagagtacccatcaaggaaacaataatagtcatgaccggcaagtctttcaagcatctggtccatgaatggaagtggaaaatgatcttttcgggttgcatcgttcagcctccgataatccacacacatcctccagcctgtgatggttcttgagggaatcaagtcattgttgtcattttgaatgactgtcatgcctcccttctttggaacggtttggactggacttacccaaggtgtgtctgaaatcggatatatcatacctgcatctaaaagcttgacaacctcttttcttatcacttctttcattacgggattgatccttctttgtggctgccttacaggtttaacattactttccataataattttatgagtacaaaaggagggatttatacctttgaggtctgaaatagaccaaccaatagctgacttgtgctccttaagtatcttgagcagtttttcttcctcaaaccattccagccctctgttaatgatgattagataagtctcatcctcacctaggaagacatatttcaagtgttcaggcagttccttcaattcaactttaggtgctccggttgggatgtcatcttccttctgctccagcttttccagcacaggttctgctgtgttttctgcagctgcaatgctggattctgcagtaatttccgttgttgctatgtttgctgtctctgttgcataatttcctgcagcttttgaattttcttctgcataaattgctgcacattctgctactgcaactgagttttctgctgcatacttttatgcattctctgttgctgctttctgctaaatccttaacttcagttgtttttaatcctgctgtaatacctgcacaaataacattatccaacacatctagcctaaaacaatcatgttcatcagttggatgtttcatggcatcaaacacattgaatacaacatattcatcattcaatcttaactcaagctttccctgctttacatctattaaggccctagcagtggctaggaaagaccttcctaacagcagagggatttcactttcacccttcatgtccaacacaataaaatcagcaggtaatataaatttgtctacctttactaaaacatcctcaattactcctgagggtttccttaaagacctatctgctaattgtaaagacactcttgttggtttaagttcagatatgcctagggacttacacatggataatggcattaaatttatactagcccctaagtcacaaagtgctctccctacatttatatttcctatgcctatagggatgttaaaacttccaggatctttcaatttaggaggaagtttcctctggattattgcactgcactcctcaatgagtgctatggtttcacaatcttgcagcttatgtgtcttagatagaagttctttcatgaattttgcataattgggcatattagctaatgcctcagcaaatggtatattgatgtgtaacttcttaaacatatctaagaacctggtaaattgctgcttctgcaattgttgcttagtctgcaccggatatggaggtttctcaaagcgagaaaagtcccacttctttggttgaggtgcagaattctgttcatccaaattttctgcagctttttccttggctgattcagttgctgcagttttcttctcagcttcctttttacttgcctcaggcttttctggtgtagtcaataccttaccacttctggttgtgacggccttggcatgttcccttggatttataattgtgtcacttgggaactgacctggtggtctctcagccaactgttttgcaagctgaccaatctggttttccagatttctaatggaagcatcttggttggttctgtgagctctcgtttcagctataaaggcattggttgcttggatatgttctgttgttgtctttgtcagctgcaacactaccttttcaagttcagagggttccttgttgggaataggagggggctgcaagtagttattggacttgtagtccagaccacctccctggaatctcctttgatagttatttcctgcagaaaaattgttattcctctgataggactgctgctggtacggttgttgctgcattggatcattccaaatgccattcacctgcacagggtcagcaccaacaagaatagggcaaacattagactcatgctcaccttggcagtactcacagattacatgtggttggctggctgccacttgtgctgcagaaacttgtaatttgtcaatcttttcagtcaatttggctagttgttgtgccaaaattttttgctctgcaagcattgcatcattagtggacagctgaattggttctctctttggctgatggttgatgctttcattctcattatgggccaaagaattgataagctcataggtctgagctgctgttttagaccttatagtaccccttgctgcaacattaacgatcatacgtgtttcaggagtcataccattaaagaaaatacgtacctgcttacctacaggcatataatattgtggacacctcctgattaattcttggaatctgttccaagcagcacatagggattctctgccattctgagtgaaattggtgattgcattcaccaaccggttatatttatccatggaaaagtactcgtcaaagaatcttgagactaagtcctcccaggttgagatgctatttgatgtttgtcggtttagccatctcaatgcatttcccttaacagcaaagggaaatagacttaatcttactgcatcatctgagaccccttggtgtcggatagtgtcacagattctgagaaatctgtcaatgaagtcatgtgggtcttcagaatcttcccctccaaactgactgcgttccaccaatgctatcaatgaagggtttatatcgaagtggttagcttgtattggtggcctcacaatgctggagttgggtctggtgaacataggagctaaaatatcctccattagttcatcctcaggtcttggctgattatttctttgttcagccatctctgcttctgactctaattcaggaattgaatcaaagtcaaaatattcagcttctctctttctttgtctagctagtctccttcggattgttctttctatttctggatcgaattgcaaatcctcagaactaactgaacctcgcataaaacttagagaagctattagtaataaaaactccaatcacaaagattaaaattactgtaaaaatccgttaaccaatccccggcaacggcaccaaaaacttgttgcgactattccgcacactacggcaagtggaccgatcgtttcaagtaataaactaggtaagtgagtatcgttctccactgggattggggtgacgttcacagtaataaggagtcaatgtgattgaaaataaaaacagaaaatgttggaagaaaatagttggattgattggttgagtaaaacagaaattaaaatcaacagtaaattaaattaagaagttaccaatggaaaaaaaattgtggtcaggcgcaatcccctttgattcctccctccttcacttgactggtttattagtttaatttactcaaatgataaatctctcctaatttcgtaaatcctaatttattagcgacttatccttttaattcgatcgagaattctaatcccttagcaatcctgtcaaactaagcatttagagaatatatcataagggttcttgttatgattgttcagagaataaatcttttctaaattagttaatccctaatcctttagtgaattaaccctttaacctgaatcgaaaacctaattccttactgaaatctatcagtttaagcacttaaaagaccatattataatttctgcagctacgcatccctatccctaggtgatgaacaactgttattctaaacaggtcagaaattagaatcccaacgtccccattgcgaatcctaaccctagatacttaattgaagtgatcagttccaaataagaatggaaaataagaatagaatagaataaaacaatcaaaacattattattcaataccagtcaaattacagaggagttcacatcagttcatggccttcccacaatacaagatttagcatgccataggcctcaagaacatcagagcagtagaataatacatgactgtgctgaaaccctagccttgattcttgatttccagaggtttagaatgatgtttacaatgtaaaagatgatatccagatgtccttttctcagttcagaggcctttcttttatagatagatttaattagagtaataagacctaaaactgtgctcaaattcgaaacagataatttatttaaggaaacagaatccttgtggcgcgattcgcgcggagtctcgcgctaaccgcgccgcctgttcgaacacatggccctgatcgcgtggacctccatgctaaccgcgtggagtcttcgagaatgaaggtctgatgctgagcttatggcgttgatcgcgtggatgtggcgcgatctgcgtgggttattcgagttaaatggcctggcctcatgtccttggcgcggatggcgcggcttcggcgctgatggcgcggtgcttgcggccttttcacgctaatcgcgtgaactcccacgctgatcgcgtgggatcttcgagaatggggccttcaattcttcacctggcgcgatccgcgccggacttgaaatcttgttttcttctccttttgccttgaacttcctctttttaacctgaaattgctcaattggtaacgaattgaatttaaaacaaataaaatgataaactaactattcttattctattttcctaattatttaactaaattatatcctaaaactagcctaaaactaggatgtgtttgcaacacatcatggtgcatggtcgtggttatggaatagggaaaaaggaagaaagggagggttgccgaaaattactcttaatgtaggtgttgtagtcgaagacaagaaaaatggaaaagaatggtgaaaaaaatgaaatgatgctgccggaggtgattttcggcaatggcgcatagtggctaacgacaatggtgaggaataagtcagagggataaatcgggaaagtcaagaagaaaagaaaaaaattcatccgtgggattaaaatttgataaatctaatggtggaaattcactttatcattagtgagagacctattacactctcccacactagtctgtgttagattagggattaaattgtacattatgaaagatttaagactaaaaataatattcaacgaaaatacagagtctaaacatatatttttttcaaaaatatttcacatcttgctttgaattagttgtgtgacatttgatagcgagtttcatactaaattatcccatatgcaagatgtaactctatatataagatttaggatttaaatcaaggataataagaaccttaaatcctaaattagaattgtagatcaaaagatgtgttcacatgccaagtgtgaagatgattctgatgtattgaagtagaatgacaaacacgctcaaagcaatgaaagcatggaaaatgtgccggaacttgaagaagttaagcagagttttccaataagcaaaccggctgaagtgtccattcgaaattttgacttaaatttggacccagatgaggatatggattcattaaacacaccaacttctatcccaactagttcatctgcaaaatcagtgtcagaagagaagcatgaggaataccctggatgatccctgtctgaaatggaaaaaatgaccattgatcccattcaactagccaacataaatggaaggattgatgaagatgaagaggattatgatgaagaaatgtagatgaacatgtgttggtttattcattacttctcatataggcaggagcggatccagaaaataaatcaaggagaggcactcaaaagttcaaatacatatccagaaaaataattacaatggcatccttctaggccttatttttggaattccttcataattgccttattatcaatgctttcaaatacatctttttcaatataaggcactaaacaatcattcaaccattcatcccccatccaattacgaagtgtagtcttgatgtatttcatagctgaaaatgctctttccacagatacagttgctacaggcaaagttaatgctaactttacaagtaaataaaccaaaggatacacaatatgttttttcttttcaatcataatcttgacaagctcagctattccttgcaaattcaagaaatcagaatcactttgcacatcaataatatatgtgtcaagctgatattcaagcatgacaaaatcattcaaatcaaaatctgaaggatagaagttagcaaattcacacaacttattcttgtcaaatgtcgagaaagagttgcacggatttaaacatgtcaagcatttcagcaaattcgaactaacttcactaaaatgatcattcaactcttcaagttgagtatctatcactgcataaaagatgtcaaccttaaagtgatgcagatgaataactagtcctctacgttttgctctcccttgtaatgcaaatacactttccatatcagggatatctatatcatgtttgatacaaaatgcagaagtcttctgaaatagattatctcacccattatctcttgtcttctgtaataacacttttgaaacttttacaagattcatagcattcacaatatcttgatcttttctctgaagtgcttgggacaactcatttgttattgctaagaccttgatcatcatgttcaaaaataatacaaattcaaaagtttgcatacgcatcataaggccagaggcttcagacctttttgcatgtgtaagggttgtatcatcttttataatttctagcacatcaagcacaggatcaaacaatgtacacagacttaccaatgatcggtaatgtgagctccaacgtgtgtcccctggtcatgacaaacttatttcttgattcaagtctctccctgattgaacatcatcgcttgcgatacttttgaccatctcatcaaattgtttttctctcaaaatatctgctcttttgcaagaagcactaactacattacagaccaacggtataaaagtaaagaagtcagtcaacgcgtaaaccttttttgcacaacccgctaaagctaactgaagttggtgtgcaaagcaatgaacatagtaagcaaaattattttcaactaaaatcaagcttttgagaccactaaattgtccactcatattactcgcgacataataagcttgaccacgaatctttgtcaagctcaagccatttttggcaaaaattaactcaattgtttctttaagtgaactagctgtagtatctgaaacatgaacaagaccaataaaacgttcaataatgtcaccgttgcagttcacatatcttaaaacaatggccacctgttctttaattgatatatcacaagcttcatcaactaggatagagaaaaaattatccccaatatctgaaataatagctttggtaactaaactagcagcaacattagtaatatctttttgaatcaagggagctatcattttgagattctctgggcattattcaaagatacattatttacctcttcattattttcacaaaggaattttacaagctcaacaaaattttcctgattcattgaagcatctgtctcattatgtccctggaaagccaaaccttgtcgtatgagatatcgaacacatcgaatagaaccaatcaaacgaatacaataatcctatttggctttgtcagaaatgccaaacataacaatgtcaatatgttgattttcattcatcaaatctttggcagcacttaagcacaaattatgagtgcttccaactttcccaatatgtttaatcagccgttgtttgtccttccatttgctaaatccttctacaacaaatgaatcatgaccaccccttccatcaccatgctcacaactaaatagataacaatgcaagcaaaatacaacatcttttgattcactatactccaaccaagtgccaaactcattgtaccattgaggactaaatctacgcattttacccccaaattaacgattgaggaaagttgtcaagttttgaaggaccattcgttagataaattcttcgaatcatttccctttcttgatcactctttgcaatgctcataacagaaagtcttttacccggatcaggaacatacaaatcattttcctttcttgaacactcatttggtttatcttgaactcaatcaatagatgaagaagattcatgttgcggattcggtaagtataccgatcgttccaagtaatataatgataagaaagtgtatcgttcccacgaggattgtttgaccaatgaaattataattaaatccaataggttggaagacaaatatttatgagaaattgttgttgtgtgtgtgtaacaattaaattaaacctaattatgaacattaattattatcaacaagtaaataagattataacgatatgtaaagtaatgtagctagggtaacccacactaaatgcttcctaccttcttacatgaattgtctactacctttatctattacaagttactcaatacatgcatcttcatacagtaatagctaggtcctactcccatagtggccttaaccctttaacccaattaaataccctaattccttagtagtacccgttaggttaagcattaaatgatgcattaaatgtttgcaagcatacactactatccctagacaatgtaaaacttgtcactttacccaagtccaagcatagaatcccaacattcctattgtaaaccctagctttcaatacccaactagaatgatcagttccagcaagatagaaacatatatgcaatcaaagtaaagtgaaataacttgatataaatgaagaatagcatctaatacaatccaaaggaggttacattcagtgcttagccctaactacaatatgaaatcagccaaacctcattgtggttggctgtaatacaaaaaatggcatacccaactgaagtgcaaggagaagaagatggagaagaacctcctcttgagccttcaatctcctaaaaccctagctaaggtacccaagctcataaaaccctatttttgtgtttttctccctccaaaaattcgtgcattcaatgctgaggcttcagtatttatagtcctgcttgtgaagtctctgttttgcccttggcagctttaattacacagcttttgtcgacctgtggcgctgatggcgccaacttacagagcttttggcgccaatgacatcaacctggcacgaatggcgctaggatccagagatgatggcgtgagtagcgtcgtgtctgcgttgatggcgccaaaagacagtttgttggcgctagtggcgccatattcacgctagtggcgctggactctagaattgtggagatggtggcgccaatcatggcgctggtcactccagtccttcttccaggcttgattctttctttaatttgctacttttgattgatttcctggcaatttacagtattagctcaaatcacaacataataggcaatttatcaatgtttaatgctcaatttcttgcttttgatagcttaggaaccttatatgctaggcgcatatcaattcacattgagaacgtttagcactactaccacttgactttgtaaaaaaagaatctaaatacctttccatcctaaaaaatgaaaaatgacaaaaatgaatcaatatataagtatgcatttaatttggaatcaatatactccaaaatattaacaatttgcttatcctaaagttccatgccttgtaaaacagaacaaagatttcattcggatgattcgaattaaaactatcaaggtatcatgctttccagttccaggcaaaatatttggaaatgaaagcttatattatctcttaaaaaacaaaacaaatgcaaaattgaaaacaaaacacattttcccaatcctactttcaaatgcattatggaaaatgaaacagacaaacaataatctcacaaaccccagaataatgcagttatgcacatccaaaagagaaaacctcaaaatggaaaacactcaaaattgagacaaataaaacattgtccccaatctaggttcgcccctgatgccaccacaaaagaattgctaagcaacaaagaagttattgcagtaaaccaaggcatggacagactaaattaaccttcttatcttttcttaaatagagaatgcttttaaaaccaataacttatgataatgcagatttgcagtgctcactggcactcttcacaagcctcacatcatcacatcattcacaatttcacatggaaatgttttgctttgataaatgagaaattaacataactcaaaaaataagatgcacgattcactcattcacgggaatcacgggtattgggtaatcaaaatcagtaatgggtattgggtagccattggattggagacttgtccgactttgaggctggaggagtggaggttgttcatcgctgccggtgaagatgaaagacaatggtgtcgtcgccgtctctcacggttctgattctcaacttctggtggtctctctcgatctcgcgatcgatggctacggtcttaggtgagcgactaaacagagccccgaaggtggtgccgtggtggccgatgatggcgactggcgaaggcgacgaggcgcagttctggttcgagtcttctggtggtctctctcggtctcgcagggtctgctagtgtagggcactaggactaaggaacgcgttttgctgcagaaaaaagacaaggatatttgtgtaaaaaaatttaaaatcagggacatattggtaattaactttcaaaatttaaagggggggcactgcccgccaccccaatgtttcacatacgtccgcctttgcatataggcccgtcattgaaatgttcttatggggaattagagtagattttgtaggagcaatgttagatagatacttactcctttgtagtttaggaagattaggagggatagggcattgagtactctccttataactcttgttttagaataaaagtggagatatagattgttccaattagaaatagccatttgcgagtatagttaagacttatgagaaattttaatctcatgtaggtattgcttatggtaggcactacattcagattttgggtgtgttatggctcaaaattttacggggatgcctatcttaatcacacttgtatctagtggaactaactcactgctcccgcaacatgatttgcatgcaaccttttgaatttttgttatcgtgaacttattgcacgataagacaagaggaaaagaataagacattagacggatagaaataaatacgaaataaagtaaacaagatttgttatttagatgaataaaaatataaaggaaataagtgtagaaattcattatttatgtttgttttggacaatgaaagagaaaatacaaacagatgaattgtttgaaaaaattatacattttttaaaaattattttcagtatttttctaataagattattatttttttattatataatatacttatttgatttttaatatataggcaccactaatcacttctttgtaaaaccaatctcgcctcaaactagtttgtttaaacttaaaataagtaattttaaaataaatatttttttgaataaacacttaaacaaataacgttgatcaaaataaacaaaaaaagctattttttaaacataaacacaatttaaacaaatacattaaaaaatagaaaattgtttattgttgcgtactcggcaagtgtaccggttgtacaagtaataaagtgataaagaaaagtatcgttcccacgaggattgttgaccaattaaattataaattgaatcaataagttggatgacaaataaaatggataaatttgttgttgtgtgtgtatgacaattaaattaaatacctaattataaacatgagtattatagacagactatggagggttgtaatgatatatgtggtgaagtagctaaggaaatccacactaaatgctccctacctttgtacatgtattgtctactatcttcatcaaacccaagttactcacacatgcatcttcatacaatgatagctaagccctactcccgtagtgttcttaaccctttaacccactttaatcccctatttccttagtgatattggttaggtcaagcattaaatgatgcattaaatggttgcaagcatacactcctatccctagttaatgtaaagcttgtcactttacccaagtccaagcatagagccccaatattcctattgtaaaccctagctttcagtacctaactagagtgagcagttccagagagatagaaacatgcattcaacaagataaagtgaaataacttgatattaatgaaagatagcatccaatacaatccaaaagaggttacattcaatgcttagccctaactacaataaggaactagccaaacctcattgtgggtggctgtgttacaaaataaaatggcatacctagctgaagcaaggaagaagaagatggagaaccctccacttgagccttcactctccctaaaccctagttaaggcacccaagcttcctaaaatcctacttagtgttgtttccctcctagaagtcgtgcattgaatgctgaggttcaagcatttatagtgtagcttgtgaagtccctgttttgcccttgaaaactttaattacagggcttctgtcgacttgtggtgcccttggggtgagactggcgttgatggcgccaacttgcagaatgaacgacgctcatggcgctggctgacagagaatgtggcgccccaggcgcggatactggcgctccaggtgctgaagtccagagatggtggcaccccaggggcggaattggcgctcttggcgctgaggtccagaggatatggcactcctggcgccgtgctggcgctcttggcgccaaataccagaacttgtggcgcctttagcgcagccttggcgctcttggcgccagcttccagtgcttttgacgctgatggcgccactactggcgttgatggcgctagtgccttcttccaaactttgtcattttcttctgaattttgcttgaccttggcatctttgattgatatcttggaaattcatcacattagctcaaatcatacacaaggagggcacttatccatgctttatgctcaattcttactctaaaaagcttaggaaaaccttatatgctaggcgcatatcatttattttattaaaataaatattttttcaacaaataaatttaaacaaatttaacaaaagaacatcacttgagttacgagcatgagttggaccgattagacacatattagacaattataaagaatgtttttatggttttgaatctagttggaatactaataagaaagacgtgaaactaaaattccaaagtacaattaacatgatactagctctagatactcatgcttacatgcctccgtccctgattggagatatatgaagtttatatttaatatggataagtccttggaaacacagaataatcaagggtcaatctcaaagtttggaataactataatttcttattaaaatgtcgatctaaatggttcttaacataataagagtggttgtgacatatacttgaagtttgagtttgccagagtctataaatatgtaatagacactggcaagtgttcggatggaagataaaatctagaccacaagtgtttgtcaaaaaagttaaatggaaagagaagaaatagaagtattggaaaaacctccattgaagccattgcataaaaaacccacttggaagtgtgatcaaatatcagcaacaaagataaaaagtaacacaggaaatctgacaagaataatttgttctgaaatttgacaagaatgagagtatagacgcagaaaaagtgaataatgcgattgcatttgtcaatatgctcattggttgggatcaattaatgtcaatgcataacttgattaatcttttaattaccacttcataactattacaagttaattttttaagttaagatcttaaaaataaaaagaattgacctagcttgaaccatgcaagctctctttccatttgaatggttgctctaaaactggacaatgctttgaattcaagtggcagatgagcagctaagtgcagaacgttgttaccttcattgtccactgctcctactatatgctctatctttttaagtatactaaaaaaatgcttatttttcaatatatggcagccaagtgcagtaggtttcgtccattgttggggtcccttatcatggtcactagtttactattatcgtcaagaatccaaccaagagcctcatcatttcgatatatagttgattggtccaacaaatgtataacatgagcataaagaaacaagttaaatgaaagtttggtcttatatgaaacatcaattttttgacacacataattaaataattaaataaataaataaataaataaaacaccattcgcaaccgatcatgaaagcttacttagaatttctgaaggctttcgccccagcatatgcaatgctgttaacttctctttttgcctcttcatctcttgcaacggacaaatcagttggatatttttcaaataatttccttgccacatctgttacatgataagctgttagcatatagtagtttttaggataaaataattaagaaattaaagataaaatatcaaataaaggctttaaatagatataaattatcttatcattaattttatcattaattattgttattttaatatttaggaacaataaataacagaaaagaagcaaaataaagggcaactggaaattgcagctcacgcagaccgcgccaagaccacgccaatcgcgccacactcactgcctgttgacggtgatcgcgtgaaactgatgctaaccgcgcggacgttactggaaattcaaaaataagattaaagataagataagaagataagctcttagggttttgctaacctatctataaataaagaagccacagaactcactcagacgcagagagacactcagaaacacaataaacacatgcagaggctaaagaagcgaagattgagaagaaaatcaagattacagggtttgattattattcttatttgtatttctacccaccttcttcttcatatttgtactaagctagacataattatgtctagctaattcctccttgattgtggtaaaggccaaaaatcaatgtgaactcttgtgtggattggattgatgttaatgaagattattatgattgcttctctttatcttgttcttcaattttaaattccattgatagaattgatcactctattagaggtactaagggctttaattcacaatagggatattgggattttagtttctgaaagcgataaagtgccagtttgacattacctagggatagggatgaaggattgtaaagtttttatatgtcagcttaaagcttaatccgaaagggggttactaagggattagaacacttaattaagattaaagggttaaaaagaccgaggaatctgggtttaaccaattaattaaggtgtatctttgagtacttgtagtaattgaaattaattatcaattcaattaaacaagtagggatcaaaggtgattgtgcttttaccacaattgttcttcctcactgcataactttcttgttaatttaaatataattctgttttcaatatattccaagttacatcacaaaatcacaaatcaaatttattttatttttatttcttctaattttaagataataattacaattacattagtgcttcaatcctcgtggagaagatactctacttatcaatttattacttgaacgatcgatacacttgccgtgagttacgcatcactttgtgaagcgacaagtttttggcgccgttgccggagattgagtacgccaatttaattgtaattttattttttaaaattggattttgttttactaatctgtttctttagtttatgcgaggattagcggaacctgaaactttacagtttgacccagaaacagagaagactgcaagaagaaacaagaagctagctaagcaaaaacagagagcagaaaattctaattcacaaactgcagttgaattagagatggctgaaggcaacaataaccagtcaagaccgggagatgaattaatggaggacatccttgctccattattttctaaaagatattgtcagaagggtttctgatttaggtggttctgttgtaactagtgatgatcatactgtcactaagaggtttgtggtctgattaatactcatgttactaggaacatgttttttgtgtggtgaattttatttatttattttatattaggaaagatgatgataatgacatccacgaggatcccaagagaaataacaaggtaatatatcaattcagactgagttggcttaaatttttcttttttgactaaaccttctgctgagtaattatctcttgtcatgcagactgaagcttttgctggttacaaaagaatttacttcagttattcgggaaattcacaagttgcttcactgacttgcgaatacaagtacatttaatagtatgtaaaccttactatacaaagaaccaaaactacctggttttcttaaaacttttggtgaaaactgttttgtaattgagcaaactattcactatagaatcagaattaacacataatttggaaattctagctgagagatgcaacattctaaagaacctcgcagcagcttgatgttaaatattatctgaataatgaattttttttttcttcatgatttgcacagagcctggcattgcagtggcagaggaagggggtatcaatgtcagaagagaagcatgaggaataccctgaatggtcattgtctgatatggaaaaaatgaacattgatcccatgcaactagctaattaacttaaatggaaggattgatgaagatgaagaggattatgatgaagaaatgtagatgaacctgttttggtttagaaagttctaattgagaattagagtagaatttttaggtgtagtattagacaaatccttagtggttaggaagattaggagggctaggacattgaaaactctagtccttacaacctttgttttaggataaaagtggagatatagattgttccaattagaaatagccacggtattgttatttgagaaattttaatctcatataggtcttgcctatggtaggcactacattcagatccttaaacttacggattggattttgtttcggttgttagctttgattgtggcgttgtgtatgcaagtctgttattgtatcacaccacgtttcctctcgagtacaatttgagagcaaatcggcggagcaaactcactgatccgacgacatgatttgcacttgaaccttctttgttatcttgaatttgatgagaaatcagataaatggaaaagaaataagagagataaaaataaaagtttaatatgtatatactaacactaacagtataaaacaattttatgattttacaaaccatcatctaattataaattatcattttaaaagttaacaaatttattatatatacatgataaattgtgattggatgactatgtaaatctttttaagctctcaatacataactcttatctagaaataaatacaaaataagatgaagaagatgtattatttagattaataaaaataaaaaatatataaatttttatttgtttgaataaataagagagtagaaaacaaaaatgtggttattgcaaaaatgttcatacaaataaaaaaataaaatttaatttgaaaacctgaactttttaattatttcgttatttctcaacatgaaaatattttcttataaaacaataatttgattttttaaaatttaaacataagtaaaggaacactcctaatcatttatccttctatttcacgtcacttggtgagaaatatggtttggttaggactcattaattataatttcatttctcatattctaacacattcaatcaagaatttttttattactttatttctcttcattttaattttatatttattataactttgttgtatatagtaattcttggcagatcgagtaagattaagtctcagtgaaagatgaatgcgtaataaaaaaaagggtttgtctttgttatgatttgcagtatagtctcaaattaaggcgggaacaataagaaaggtaatatttcatgagatagaaaatgtaaaataatctcaaatttaaacacaagcttcattgttccacaaacaaataataatacagtgccttaaaacttatgccaatgtctgcagctctgtaataagttagtccagtttgggccaacgataaaatctagaccagaagtgttcgttgaaaaagctaaattgaaagagaagaaacagaagtattgggaaaacccccattgaagccactgcataagaaacccacttggaagtgtgatcaaatatcaaaaaggaggctgcagtgaaagccacaaccaaagcagcaacggcgataataagtaacgcacgcccaaaagtcaagctgggatgtagtgatttcacaaattcgctttctgcgaatcttgatgaagtgaaatttgacaagaatgagagtaaagacgcaaaagaagtgaataatgcgactgcatttgtcaatatgaagacagtaaaccacgcattggtcttatcacctggaacagtcagtgcagctgcaaatgctacggtagcaacaagtgttgacacaagcatgccagattcggctattcctttggctgtttccttaatttcttcagataacttcttgtgttccttataaaatacattaattggtctcatgcccgctttgtttgtctttgttcttagttcaggaacattccgcttcactaactatttacaaatcaagagtatatgtaaatgttggtatccaaatgcataacttaaattaatctttcaattatcacttaataactagagcaaattacaacaacacctcctaagatttagagtaattacacaaatattttttgagatattagagtaagttttaaggagatgttagtgtaatattttcaaacatataaaagatgttagtgtaatttttcaaatttaaaagaaattagtgtagaaaaataaaaaatggaattacatataattatatgaaatctcaggaaaattattgtaatttcctcaaatagctattacatattaaatttgtaagtaatacaatttcaaagttaagatatttaaaaaataaattttaggggtgatatttatttttacaaatgcacttgtattatttttaattaaaatattctattatatattggctgtttaactattatgctaaagacaatggataacaaattttaaaaaattattaaaataatcaacaaatactacatacaatgatttctatttttaattaaaacttgttacttttaaagatttaaaatcagtctagttaacataagcctaaaattagtggaattttaaatttttaaaataagatagctagaactgatcgatcccatgcgagtgaataaagaatggttgaataaagaaaactaagcaaattaattgaccttgaaccattcgagctctctttgcatttgaatgtttgctcttaaactggagaattcttcgaattcaccttgtggaagacgcgcaaccaagtgtagaatgttgttacctccatagtccactgctcgtcctagaagctctgttaatccccgtggtataatattaaatattatttcttgtcgaaatagcacaaccaagtgcagtaggttccatccatttctttggtccctataagtcactaattcaggattcttgtcaatgagcatcttcacagcctcaacatctcctgattttattgcatattcacgattctgttccaatgtttcaacttgagtcaatacttctccaaatagtcgatcacaaacgtctgattccttggcaaacattattttgtgttattagaataactcaacaaacatcaaataccattattacactggatatagataattaaggactaattcttaattttttatataaaacaaaaatatatataactttctaaaatcaaaatcaaaatggaaatgatgtcaaataagatctaaattttagcttagaacacacaaaaaataaaaagccattttcaacttgtgaaaggttacctgacattcctctaggcttttcctccagcatcttcactgctgcaacgtcctcttcatttcttgtaatggccaaatcagttggataattttcaaataatcgccatgcccaatctgttatacgcacaaattaaatagtacaaggcaaggtaaataaaattaactacaactaaattgaaaaaccacgtacgagttcatatatatctccttttatatacatgaaatcaatgagaatttagctaggagctgtttggttttaaaggatgatatcacagtctttcagaaacctaatagtcataattaattatttcaactgattcaatgggttcgattcagtttgtaaaacttcataatatgtaaaaaagagaactagattacaaaaaggagaaataagtacataagagaactagattacaaaaaggagaaataaggttgtttaattagttttacacttaccaaacatgtcgaacctaatggtcatcataaacagtcgttcaatatccttcaaatcaatcagtacatcaagcaggaaatcaatgtcttctggcttcatacgcttagccaacactttcacaatttcaagaatgcctctctttaatgctagatgaataggtatgtctccacttgcgtttggtattagcacgtcttctggcctcatacgcttaaccaactcattcacaaaatcatagctggattcccttgctgctatatgaagagctgcgtctccacttgagttttctattagcatgtcttctggcctcatacggttaaccaactcattcacaatttcaagaatgcctctctttactgcttgatgaagagctgtgtctcgacttgagttttgtattagcatgtcttctggcctcatacgcttaaccaactctttcacaatttcaaggctgccgtaacctactgctagatgaagagctgtgtttccatctgagttttgtattagcatgtcttctggcctcatacgcttaaccaactctctcacaatttcacccctgccttcacttgctgctagatgaagagctgtgtctcctcttgagtttggtattagcatgtcttctggcctcatacgcttaaccaactcattcacaatttcaagactgcttttacgtgctgctacatgaagagctgtgtctccaaaatattctaacggaaagcgtaccatatcaggacatttatcaataatcgattttgattcgagccactcattcctccacatatgtctcgtcagatcttctattaaagaacctgcaatactttcaaacttcacattataacatgtcctttatataataatcataacgtacttttagtatttagttgcaaagaagacccttttaatttctcgtttacccttaatctgtaaaaattctcttggaaactcgcctcaaattttgaattcctaataatttcatcagttgtaaattgaaatctaccagagaaattcgagattacgtagtcgaagggatccaatcatcaattacctttaattaagtttgaacattgaatttcaatttgtgtttgaaaattaattctatgatgatgagtaaaagtgtttttgagagaagtcatttattttttcttttcttcagttgacaaaagctaattgatcttaacatgcgacttatttatcctcagtttaaaagtgattctacttttttttatctttcaaataaaaaataataattttctaaacccattgttgaaatatcattcgtataataatagtataaatatatttttcttaacgtcaggggtttcaaattcaattttttcaaatggtaaaaaataaacaaactcttaagacatgatctctgaaatacaccctactgtgaatgcaatagtttcaagtataacttactcagctcttctggagtcatttcattcacttctatactttcatgttttggtgccagtgagtttgttgaagtggcaattggagtttgctcatcaatttgaataggagtatgatctggtggaatctgaattatgtggtcttctgaaacttcggtagtggagttcatgatttaattctagggaaaatgaagtgatttggatacctctctaaaattccctgtgttacttctttctttccagcctgagaagcttaacatattatatatggtggtaaaacaagagcccttaattaattatttttccaacttgcacttaaaataactatttccgatgtgacattttgtggattatagctatgttaattgaatctgttcaacatttcaaccccacagttttcaaaagctttttaagttgaatgatttctaaatttatataatattaattcatttttaaagtgaataagtatattcattaaatttgttaacagaaaaaaatattcattataaaaaaaaatatattcattaaattgtgtggattagcgagactcgctatcaagacaccatgttaattaacttactctcaatttaaaattatatttcttcgttgtacaatgatatgatatctttacacacctaaaaccttcgatttcctactcttatattgttgacgaaaactttctgccatagcggtggttatatatttatccaacttccgttgacgcatttaattatatgattatatcctaactctggtctttttatactagttataatcaattactccaacaaccattgaactcaaagctaagactagatgcattttattatcggaatatgtataaatttattaaactcactccaacaaccattgaattcaaagcaagactaaaagatagttacccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggtaattgttgttatgatatttttttatgtatgttttttttattaatgataacatacaaaaggtaacggattgatgatattgaataggagtatgatctggggttggtataaactgaattatgtggtcatctgtaacttcgatgttggagttcatgatttaattctatggaaaatgaagtgaattggatatctctatgaaattccctgttcgatcagtgttgcttctttctttccagcctgcgaagcttgaacatattatatacgatggtaaaacaatagcccttaattagttttccaacttgcacttaaaataattattcccaatatttttcttccttgtacaatgatataatatctaaatattttcagtgttagatcttgaatttaagatttgatttttattaaattttttaataaataaggtgaacatatcttcaatataaagaatgaattcttggagaagaattctaaagatgcactatatatatgttaaaaaaagaatagtttttttttttcgtttatctcccctagctaagatcttaaaatgagatctatcattaaataaaaaatggaagagatcttgagagattttcaatcttccatgacaatatggagtccaccaaaaagtgatctaagatccaaatttggcatgtatcactaaagatgaacaatgatattaaattcaagatctggtcttcactagatttttcaataaaggagataaacacatattcaacatgaagaatgaatttttgtagaataatccttaagatctacacaatattcaaaaaataataattttttcttctctctccctaatatttcaaaatgagatttaccactaaagaaaagaataaaaaagatattaagagatattcagtcttacttgacactatagggtctactaagaagtggtctaagatcccaatttgagatctaccactaaagatgtaagcatctttagtgttagatcttaagcaatgatcttgagttcaagatttgatcttcactagatctctcaataatagaagtgaacagatctctaagcatgaagaatgagttcttataaaataacctcgaagatatgtacagtattcaaaaaagaataatcttttatcctctattttcctctcctaagatttaaaaatgagaattactattaaagaaaaaaatagaagagatctccataaatatttaatcctatgtgatactatagggttcaccaaaaagtgacataagaacatctttagtggtagatcccaaattgagatctttagaccactttttggtagacccataatgccatatgattaaatatttcttacattttttttttagtaataaatctcatcttgagatatcaagaagagagatgaaaaaattattcttttttaaatattgtgtatgtcttaagggtttttttataataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctactgttaaatatgtttattgttgacgaaaactttcttccatagttgtaattatatatttattatatattttccttccctaagattttaaaatgagatttactattaaaaaaaaatagaagagatctccatgaatatttaatcttacgtgatattatggggtcgaccaaaaagtgacataagaacatctttagtcatagatcccaaattgagatctttaaaccactttttggtagacccatagtgccatatgcttaattatatcttttacatttttttcttgagtgataaatctcatcttgagatatcaagaagagagatgaaaaaaattatttttttaaatattgtgtatgtcttgaagattcttttataataattcattcgttaggttgaaaatctatttactttttttattagaaaatttaataaagatcatatttgaactcaaaattcttgtttaaaatcttacattaaaaatattgtaagatctcaattaaaaacctattaaatatgtttattgttgacgaaaactttttgtcatagctgtggttatatatttattatatatttatctaccttcccttgacgcatttaattctttgattatatcctaactctggtctttttatactagttatagtcaactatgccaacaaccattgaattacaagatgcattttattattggaaaatgtatgaattttattaaacccactacaacaaccattgaattcaacgcaacactagaaaaatatttatttaatattttggtgaaatttattcagccattcatattaataattatttttgacattttaatccttttatgttaagtaacataaatttttttattaataataacaaacaaaaattaacaaataaataaatttatcatattttttctttcaataatttaaatttaaatttttatatttaaaaaataaatttatcaataaattacacatttaaaaacaaaaataattatttatccaacacatttttataaaatttagaaagagtcaggctataacaggagaggagagtgtaatcaatcacttattatgagaaagtattttatgaccatcagattaacttgtttaaaaatcaatgattgtaaacttttattcttttattataatcttttcttttttgtcgtcctctttcccgtattacccttttcctctcttcgtcttagcggcaacgatggtgccatgacagctggtgatagtggggatgttaatgcgtcattgcctggccgttgtgaagagtaaactggagagatcttgagagggtctttcgccgcttttcttgtggtgttctgcaacaagatttcaatcggagaaaaagcatggaagacgaaatagtcacaaagctttatataactattgcctcatttaaacccaaattggattcaattgaccagatattagtctcccaaagttttgagctttttgatatttgttgtgtacgtgtttattttttctcataggtgccaactgccaagttacgagtttgtttattgcataagcgttgtttctataccattttactctcaattttgagtccaatttgggagaataaaagacctaagattttggttttgaaaatcagatgacattttttatgacgatttgtgattatatttgaaattgcagtttcaaggaaattattgtaccattgatctgtaatatttacaatctggcagtgttttctatgttcagatatgtgatgggtggtggtgcttggtggtggctccgccgccgtagtgatcatctgtggatgtggagtagggaaaaaggaggaaaagtaggggttgccgaaaattgctttctgcttaggtgtcgttgtcggagacaagaaaaatagaagaagaaaggcaaaagaaatgaaatgttgccgtcagaggtgatttttggcaacgacgcatagtggttaacgacaatagtgatgaataagttagagggataaattaggaaactcaagaagaaaaggaaaaaaataaagaaaaaagaagaaaaaaattcatccatgggtttgaaatttgataaatctaatggtgaaaatttactttaccattatgggagacctattgcactctctcacgctagtgtgtgtcagaatagggattaaattgtacattatgaaagatttaagactaaaaataatattcaaagaaagtacaaagtctaaacatatattttaaccaaaatattagttgtttgacagttgacaccgtgtttcatactaaattatcccatgtgcaagatgtaactatatatataagatttaggatttaaatcaaggataataagaaccctaaatcctaaattataaaccacatggaaagaaaaagactttgacaaggtgtatgtgtagtttacgaaaaagataatatgaattaattataatgtgtttgaattttggctttaaaattatgaatgaacataatgacatgagtcaaacttgattttatctaaaactagttaaatgattcatgacttgcacagtagtaattttacaatttataatttcttacaatattataactttttaagataacatttatttttattattattgtcattataataaatattatgacaatttaataaaacaacgataataaaaaattatcataattattacaaaacatattagtgttaattaaattataatccatattatctcatgtatcaattattttttctattaaaagattcctaattaaataagagagaaatcatattaatatatatatttagaagagagagaaacattaataataataatatttttgaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacataattaaaattcttcctatatttatggattctaattgttatattttttttattgaatgcattttatctaacttatttttgtactcgtaaccataatagtgtgataaatcattttaaaaaaggaaatattatatttcagtttaattattggtagatttgggtttaattatatatatatatatatatatatatatatatatcaaaataactatttgtaatagaaaatcagtgtatgtagacattcaaatccattttgatcattacaccatcaaaaccaatttaattcaaacaacagtctctcttaataaatccattttcagatgttgatggagtatggtttgaccctccgaagtattttagtaatcttttcatcaacgatattttagagtgaatgttatggtgctaatgagattggggtgtcaatagaattgagaggtgaatcccattaactagactttgctccccgtttcttaaaaaaatcatttttaataactattatccaaacaaaaattacattattatataatcaattctaaccataattaattatgtaaaatcattttggtgcccgcctttaagcatattctacaatcatcttctatttccaaatcgacattgcttagttttccatctccttcaatcatcttcttgccttgacttgaaccatctacctatagttgttggagagcaacaacaaacaagtgtcaattacaaacattggcaaactgcaaacctatacaaaagcagaaaaagaactgaacaaaaacaattttcttgaatgaatcaacagcttaatattaattaaatatccatccaagagcttattttgaaacttttatacattatgatgcccgagtaaatacataaaattaagcttttcacaaccattaaatccattcacaaatcatggctacatctttgaaaattggattacgtgttttttcaattgtatgtgcctgtttgctcttctattttctccgtatagactacgaatgttacagtagaacatgagtagcaatatagagaaaaataaatgcaaactaactaaatgataggataaaacacacaagagagatcaaatttaaggtattgtgtttgtttgaggaagatattcgcacacgaggttgaaaccagtattagaaaaatcatcttcaaattggacaattcaactactgaactgctcaaataacttgtttgaatgtctcatcagtaggctattggattgatttgcaattggttagtagactatcttttagtttctctctgatcacaaactcttttttagcttagcaaaacttgaaactaattcttttaaactaattttggtttagtttggttcacaggaacaatttggtgcaatctctctgttttcgattcaaagcccaagtatagaatcaaagcccaaagcccaagtatatgcacttgtgtgaattttccatgcctttctttaatttgctgacataaggggattagagcttatcattagcaaaaaagggtttatcgtccgaggaattgaagtttagctaaataagagaaattgaatcacataatcaagacgaccaagagattatcttagggtggaatcaagggaatttcaacacctaactatttttattaattgatttttctagtacattcaattataatgtttctttcaatcaaattaaaaaaagtctaaaaattcctaattgtttatctcttaaatcaaaagagtaatcgataatttgattgattgtatatttgataaaccaaatttttcattgatacaataatttgtccttattttatcaattgtacaactagtacacttgtcgtattctaaccaaactccaacaatgtattggtaaaaggtgactcagttgatctttaagtcactttacgtgaagtccacattgcccacattaggattagtgttagaaaacattacagttcagagtaaagctttcaatttaatttccatataactaaacgtgatgggaataaagtaagtagaaccgtagaaatatagatgacacaatttgtttgatgttaattaatgtaaatgtactttctcttgatattcaataaatatgcatgttgtcatcgttaaaaaataaaaagataagctattttttagtttctaaattttttaaatttatctttttagtctttgaattttttatttatatttttcatctcttattaaattggatgatgcattcctgtgtttatcaatttattcgatctaaattcctctatggatattaatgaaaaaagaggtccttgactgcttgggcaagtcctcgcgagggaactttatttgttgaagtatgtatttcatttttgtttgcttggaactataataacatatccgtagagatagtctcacaattgatttttaaggcagcatggcacttcgatcaccaaaggttcattccattgatagagtcatcacaccctcaaatacactctttttatcccactctctttcattgctccatctcatcttattttttaacttcgtcctcattgatcctcactcaacctctttgccaatgaataaaataaaggggcaagttacttgaaaggcatagggatggactgtttttggttcttaaacatataaataataaaataaaataaaaacttattaagtgtcataacctaaattttagttttagacattttagtaatgattgtgtaatcttattgaattgattattggcaggctaggatttaagaaaattatgcaagctgacgaggatgtagggaagattgcagtggctgtgcctcttctagtttgtaagtagtctttctctttcatgcatattctagggtgttttcttcttctcttgaaaaatgatttttttttggtttttttttttgtgcttttggaagtttctatgaattatctctgattaataattatttgtgtttatgtattgcagctaaagcactagagctatttctgcaacatttgtgtgatcgaacatatgagataactttgaggagggaggcaaagactatgaatgcttttcatttgtaagtgaagtttatattattttcttggttcaaatttgtgtctatgtcaagtctgttcaaggtggttaccaggctgcaggtttctttcttttggagggcggttattactatgtacttataagaacatcagatctgcaattctaatgataatgtgctcagtctcaaacaatttccctcttgtgccttctatttatcgcatgcacaaacatgattagacatgtaaatgacatctgcagaagcaaatgttgggatgctcttgcttttggaacatgtgctgtttgttctagtatttaccttcactttccagtttctaaaatgtcccgagttacttgcgcccttgcctttgcagaaaacagtgtgtgcagacttttaatatctttgattttctgaaagatattgtcagcaaagttcctgatttaggctgttctgttgaaactagtgatgaccatgctgtcactaagaggagatttgtgctctggttaatactcgttacttggaacaagttttcagtatgctgaactttgtttactttatattaggaaagtttccggagatgatgaaaatgacagcgacgaggagctcaagagaaaaaagaaggtaatttatcaactgtattcaattacttcaacagtggttaccttaaatttttcctgtgtgattaaaccttttgctgagtaattatctcttgtccatgcacactgtgaacctttcgctggatacaaaaaaatttacttcagtcaatagggaaaactcactagtggcttgtgaatgcacgtttgtctaaatgtctaatagtctgtgaggctaggccacacttcaacttaaagcttactacacaaagcgccaaaactgtctggttttctgaatacttttgctgaaaactatagaattggcactaattattaaatattatctgacttatggcagcctggacataagagtggcagaggaaggggtaggggcagaggtaggggttgtggccgtggaattagaactgtagatcaaaagatgagttcacatgccaagtgtgaagatgattctgatgtattgaagcagaatgacaaccacactcaaagcaatgaaagcatggaaaatgtgccggaacctgaagaagttaagcagagttttccagtaagcaaaccggctgaagtgtccattcgaaattttgacttaaatttgaacccagatgaggatatggattcattagacacaccaacttctgtcccaactagttcatctgcaaaatcagtgtcagaagagaagcatgaggaataccctggatggtccttgtctgaaatggaaaaaatgaccattgatcccattcaactagcgaacatagaaaaaaaaacgatgaatctatcttcattctagtgtaatagtttcctcaaaaaggaacaactggaccaggatttttccttgtctgcctacgtacccccaatggaaggattgatgaagatgaagaggattatgatgaagaaatgtagatgaacctatgttggtttattcattacttctcatgtaggcccgtcattagaatgtttttatggggaattagagtagattttgtaggagcagtgttagatagatacttatccttagtagtttaggaagattaggagggatagggtattgaatactctccttataacccttgttttaggttaaaagtggagatatagattgttccaatcagaaatagcgatttgccagtatagttatgaattatgagaaattttaatctcatgtaggtattgcttatggtaggcactacattcagattttgggtgtgttatggctcaaaattttacggggatgcctacttaatcacacttgtatctagcggaactaactcactgctccagcaaatgatttgcatgcaaccttttgaatttttgtcatcgtgaacttattgcacgatgagacaagaggaaaagaataagacgttagacggatagaaatagaaaggaaataaaaaagatttgtaatttagatgaataaaaatagaaaggaaataagtgtagtaattttaaaataaatatttttctaacgttgatcaaaataaacaaaaaaagctgatttttaaacataaacacaatttaaacaaatacattaaaaaacagaaaattgtttattttattaaaataaatattttttcaacaaataaatttaaacaaatttaacaaaagaacatcacctgagttacgagcgtgagttgggctaagtagacacatataagtttgagtttgccagtgtctataactatgtaatagacactggcaagtgttcggatggaagacgaaatctagtgtttgtcaaaaaagtatggaaagagaagaaatagaagtattggaaaaacctccattaatgaagccactgcataaaaaacccacttggaagtgtgatcaaatatcagcaacggagataaaaagtaacacaggctgcagtaaactcgctttctgcaaatcttgatgaagtgaaatttgacaagaatgagagtatatacgcagaagaagtcaataactattacaagttaattttttttaagttgatattaaaaataaaaggaattgacctagcttgaaccatgcgagctctctttgcatttgaatggttactctaaaactggacaatgctttgaattcaagtggcagatgagcagttaagtatagaacgttgttaccttcattgtccactgctctactatatgctctatcttttttttaagtatactaaaaaaatgcttatatttcgatatagggcagccaagtgcagtaggttccgtccattattgttgggggtcccttatcatggtcactagtttattattatcgtcaagaatccaactaagagcctcatcatttcgatatatagtggattggtccaacaaataatgtataacatgagcataaagaaacaagtaaaattaaagtttggtcttatatgaaacatcaattttttgacacacataattaaataaataaataaaacaccattcgcaaccgatcatgaaagcttacttagaatttctgaaggctttcgccccagcatatgcaatgctgttaacttctctttttgcctcttcatctcttgcaatggccaaatcagttggatatttttcaaataatttcattgccacatctgttacatgcacaaattcaatagcgatggtgtattgcatatgtacaaggcaaggtaaaattgaaaaaccacgtacgagttcaactagataaaaaaaaggatgtttggttttacattcaccaaacatgttgctgctaatggtcataaaaaaagtcgttgaatatccttataaaccattttgtgaagcagatcctcagaggacaaaatttgcaccattttgttgcggccatataaaacagccaagtttggtatttttggataccaagtaatcatacaacaatcaagataggagaatgagaaaaaaatgaaagagaaaataacacatagagtttaccctgatttatctaatgtgggccacgtcaagctattacctatattttcttacacattcgaataaattaaaacactcagattacaagaaaatatataggcttaaaaatcttaagtaccgtaactattcatggacccaagtccaaactacaaataataaaacacaaaacttagtgtgagccataccgaacaagtatcagcctagaatgatttgttatgcaattctactaataatgtgctcagtctcattaaatttccctcttttgccttctatttctcacatgcacaaacatgattacgtctttatcatcggaaggaggtaattgttttttgttattacctaggactattttaaataattaggttaaaaaagttatttataatttttttaaattatcatttaaaaataacgtaaaaaaaatataaaaagtaaaaaatgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcgtaaaaaaatttacgtctttaaagtcgtatgttaaaaaaaattatattgaagtcgtataattttttatgacttcagtttaaaaaaattaaaaaatatataagtcgtaacctttgttacgacttacggtatatctatttctagtaaaaaaattataatctactcccaaataataataacaaaaaataattacccacttcctgtgataaaacccatgattagatgtgtaaatgacatctacatctacagaagaaaattaaatgttgggatggtcttggttttggaacatgtgttgtttgttctagtgtttaccttcactttctagtttctaaaatgtttgagttacttgcatccttgcctttgcagaaaacagtgagtgcagacttttaatgtctttgattttctaaaagatattgtcagaagggtttctaatttaggtggttctgttgtaactggtgatgatcatactgtcactaagaggtttgtgctctgattaatactcatgttactaggaacatgttttctgtgtggtgaattttgtttatttattttatattaggaaagaggatgataatgacagtcacgaggaccccaagagaaataacaaggtaatatatcaattcagactggaattggcttaaatttttcttttgtgactaaaccttctgctgagtaattatgtcttgtcaatgcagactgtgaaccttttgctttacaaaagaatttgcttcagtcattggggaaattcacaagttgcttcagtgacttgcgaatacaagtacatttaatactctgtaaaccttactatacaaagaaccaaaactatctggttttcttaaaacttttggtgaaaactgttgttgtaattgagcaaactattcacaatagaatcagaactaacacataatgtggaaattctagctgagagatgcaacattctaaagaacctcgcagcagcttgatgttaaatattatctgaataatgaaaattttttttcttcatgatttacacagagcctggcattgcagtggcagaggaagggggtatctgttggataatttccgtttttagttgatggagatatctttttatttgataagatataatattgttatttgataagatatcttctgtttgatttgataagatattatttgatcaaataatatttgatggtttaggcccaacccatttcatcctataaatagatgagtaagggtggaggcaaaacacacagaaatttgagagcctcaagtgacagtcttgagtgccatatttgagcaagctaccgtgcttgtatatttgagagcttagagtgaaacactgtgagcgtttgagtgaccaccattgttggagaggttgagtgtaccaccacattggtgtgtttttgatgcattgtaacccatatttgttatagtggattttgatactggactaggtcccgtgactttttcttttctcacattgaggaaggttttctcacgtaaaacagattgattgtctctctcgctcctctttttattttattccgcttccgcactttgatatttgagggtccgagattacccaacagtggtatcagagcccaggttcgagggttctgaaggagccgagatggagaccagtggcataactcatgacagagatatgttcaagttgaccgcagataacttcaactattggaggtcgatgatggaggatcatcttatctgcaaggatttatatgatcccattacccttgaagtgaagccgaccgggaagtcagacaaggagtgggagatcctgagtcggaaggccgtggccacgatcaggaaatatatcgacaaaagcctctttgagcacgtgtctgagttcacaaacgcgtacgaattgtggaacaagttagaatccatgattcagaagaagactcccaggaacaaagcacacctgattcgccggcttgtgaagctagaatacaaggacggcacgagtatgattgagcacctcaacacctacaaaggtattttgaatcaactgtccaaagccaacatgaagattgatgacgagatgcaggctttgctgttgctgagttcgctaccggaaagttgggatactttggtggtgactttgagcaactcggttccagaaggaaaactgacgatggatgccgtgacagacagcctcctgaatgaaaaagccaggagaagagaacgaggtgtatccagcacgtttgaggctaacgttgctgaaaacagaggaaagactgacttccggggtcgtgacaagagccggggtggacgagacaagtccagaggccggtctaagtccaagcatgatttgaagtgcttctactgtgggaaggtaggacacaagaagccggactgcaggactctgcagaatgatgaacagaacggctgtgtgaagccggatcagattgttcccagaagaagaagtgattagagcaccacggcagtggctgctaacccgaataccgagatattcctccttagtgaggaaatgttgaacatagcccatgatgactgcacttggattgttgactccggtgcctcgttccacgtcaccccacatgagggattcttctccgcttacagaaagggagattatggtgtcgtgaagatgggaaatcaggtgaccagcaggattgttggtgttggtgatgtaatccttaccactgacacagggtgtcgggttacgctgaagaatgtaaggcatgtacctgacatgcgtttgaatttgatctcggttggaaaactagatgatgccgggtcagtaaattactttggagaaagtagatggaagctgaccaagggaagcttagtcgtggcccgaggaaagaaagaaggctccttgtatgtcatgcaaggaaagaccaatggcggagaagccaattctgtccgagatgaaccgagcttggagctgtggcacaagcgcctcggccacatgagcgagaaaggactccagattttggagaagaaacaactactgactgggttgaagggtcaagtgctggagagttgcacgcactgtctagctggaaagcagcaccgagtttcgtttgtgaaatcggatcaatccagacgatgcaagaatatccttgatctcgtccatactgatgtttgctccatgtccgagagatcactcggtggagctcagtactttatttcttttattgatgatcactcccgcaaagtgtgggtttatcttctgaagacaaaagaccaggtactccaatctttcaaagaatttcacgctatggtggaaagggagactggcatgaagttgaaagttgttcgttctgataatggtggtgagtattgcgatccctttgatgcttactgtagagaagccgggatccgacttgagaagacgccccccaagactccacaattgaatggactggctgagaggatgaaccagactattgaagagaaggtccgaagtatgttgtccaatgccgcgttgccgaaaacattctggggagaagccgtcagagctgcagttgatttgatcaacctctcaccatcacgaccgcttgaaggagaagttccagaggaagtctggacgggtcgaagagcaacttatgatcacctgagggtgtttggatgccgagctttcgtacatatctccaaagatgaaagggcaaagctcgatgcgaagacaaaggaatgcatctacctcggttcgctgaaaatcgagtttgggttcagactgtgggatcctatcaagaaaaagatagtgagaagccgagatgtgatttttcatgaagatgagacacttcatgacatctcgaagcgccaagcccgggttactgtcagacgtgaagaacccggcccttctgaccgagatgaagaacccgtccctcttgtgcaaactgaagcagggggagaaactgaagatgatgctgatgaagaccgggatactgatgtccgaattgatgagaaccgagatgaagatgaagaaccggattctcaagcggctgatgaagaacagccaagataccccactagagaaaaaagaccttctatgaggtacccacctgatgaatacaccgtcattgctgaagatggtgagcctcagagttatgatgaggccataacgagctcggagaaagaagagtggaagaaggcaatgcaggacgagatgaattccttgcatgaaaaccagacttatgagttgaccgagctgcctaaagggagacgagctctgaagaacaagtgggtgtataagatcaagcaggaagagaatgggcagaagccaagatataaagcccggattgtagtgaaaggctgcaatcagaagaaggggattgattttgaagaaatcttctctcctgttgtgaagatgacctcggtccggactgtgttagctatggcagctacaatggacctcgaggtagaacagatgtgaaaaccgcattccttcacggtgagttggaggaggagatatatatggagcaacttgaagggttccgagctccaggatgcgacggcatagtatgccgattgaagaagagtctctatggcttgaagcaagcacctcggcagtggtacaggaagtttgattccttcatgacagaacataagttcatgaagacggaggccgaccactgtgtatttgtgaagaggtatgagaatggagactttctgatccttttgttatatgttgacgatatgctgattgtagggcaaaacaaagagaagattgccgccttgaagaaggcattgagctcatccttcgctatgaaggatctcggccctgcaagacagattctcggaatgaagatcatccgggatagaactaagaagctactgtggctaagtcaagagaagtatattgagaagatcttgaagagattcagcatggacaaagccaagacagttagcacccccttggccgggcacatgaagctgagtaagaagcagtgttcgagatctgatgaagacagagaagagatgctgaagatcccataccaatccgccgtcggaagtttgatgtatgcaatggtttgcacaagaccagacctggcgtttgcagttggaatggtgagccggtttctttcagaccccggcagagagcactgggaagcagtgaagtggatcttcaggtacttgaaaggaacatccgacttttgtctccgatttggagatggtgaagccgagctgcaaggatactcagatgccgatttagggggagattccgactcgaggaagtcgacgactggatatttgatgagatttgctggaggagcaatctcttggcaatcaaaattgcagaagtgtgtggcactttcaacgacagaggccgagtacattgccgtgaccgaggcaagcaaggagatgctgtggatgaagaagttcctcatggaactcggccatgaacagaataagtacgagctgatgtgtgacaaccagagcgcaattcatcttgcgaagaactcgacctatcactcccgcaccaaacatattgatgtgagatatcactggatccgggatgtggtggaagctggacagctcgcacttggcaaagtgcacactgatttgaactgatccgatatgatgagcaagccggtaccagcatgaaaatttgaaatttgctgtgaaggagccgggctgatgaattcgacacattgaaagccgagaaagaaggtcgggttgtttaaagttgaagaccccggtctcactgaaaaacggaagtgggagatttgttggataatttccatttttagttgatggagatatctttttatttgataagatataatattgttatttgataagatatcttctgtttgatttgataagatattatttgatggtttaggcccagcccatttcatcctataaatagatgagtaagggtggtggcaaaacacacagaaatttgagagcctcaagtgacaatcttgagtgtcatatttgagcaagctaccgtgcttgtatatttgagagcttagagtgaaacactgtgagcgtttgagtgaccaccattgttggagaggttgagtgtaccaccacattggtgtgtttttgattcattgtaacccatatttgttatagtggattttgatactggactaggtcccgtgagtttttcttttctcacattgaggaagattttctcacataaaacagattgattgtctctctcgctcctcttttgattttattccgcttccgcactttgatatttgagggtccgagattacccaacagtatcaatgtcagaagagaagcatgaggaataccctgaatggtcattgtctgatatggaaaaaatgaacattgattccatgcaactagctaattaacttaaatggaaggattgatgaagatgaagaggattatgatgaagaaatgtagatgaacctattttagtttagaaagttctaatcgagaattaaagtagaatttttaggggcagtattagacaaatccttagtggttaggaagattaggagggataggacattgaaaactttagtccttacaacctttgttttaggataaaagtggagatatagattgttcgaattagaaatagccacggtattgttatttgagaaattttaatctcatataggtcttgcctatggtaggcactacattcaaatccttaaacttacggattttgattttgtttgggttgttagctttgattgtggcgttgttgtgtatgcaagtctgttattgtatcacacgacgtttcctctcgagtacaatttgagagcaaatcagtggagcaaactcactgattcgacgacatgatttgcacttgaaccttctttgttatcttgaatttgatgagaaatcagataaatggaaaagaaataagagagatagaaataaaagtttaatatctatgcataacacagttttaggattttataaattatcttattattttaaaagtcaacaaatctattatatatggagttgtgattggatgattatataaatttttttaattctaaatgcataactcttttctagaaataaacacaaaataagatgaaaaggatgcattatatagatgaatagaaataacaacaaaaaaatgtaaatttttatttgtttgaataaataagagagtagaaaacaaaaatatggtcattgcaaaaatgttcatacaaataaaaaatcaaatttaatttgaaaaccctgaactttttatttcattatttctcaacataaaaatattgttaaaaataattatgtgatttttttaaatttaaacataaataaaagaacactgctaaccatttctccctccatttgacgtctcttagtgagaaatatggtttggttaggactcattaattataatttcatttctcattttctaacacattcaatcaagaatatttttttattacttatttctcttcattttaattttatacttattataattttgttgtatataataattctttttaaattgattaagattaagtctaaatgaaagatgaatgtgtaacaaataaagctttttctgtgatatgatttgctcccttcaccaatccacatggaaggaaggggaaaagctttgacgtgggttatgcagcatagtctcaaattaaggtgggaacaacaagaagaaaggtaatatttcatgagatagaaaatgtagaataatctcaaatttaaacacaagcttcattgttccacaaacaaataataatacagtgccttaaagttatgccaatgtctgtaactctgtaataagtaagtcctgtttggacaaacgatattatctagaccacaagtgtttgtcgcaaaagttaaattgaaagagaagaaacaaaagtattgggaaaatccccattgaagccactgcataagaaacccacttggaagtgtgatcaaatatcagaaaggaggctgcagtgaaagccacaaccatagcagcaacagcgataataagtaacgcacgcccaaaagtcaagctgggatgtagtgatttcacaaattcgctttctgcgaatcttgatgaagtgaaatttgacaagaatgagagtaaagacgcagaagaagcgaataatgcgactgcatttgtcaatatgaagacagtaaaccaggcattggtcttatcacctggaacagtcagagcagccgcaaatgctactgtagcaacaagtgctgccacgtattaattatcctatattaactaagtttgttaggataactaaatatgttagagcagattaattttctgttatggttattatcataagtttgttagagtagattatctttatatcataatgactgcaacttctgctatcataagtttgttagagtagattatctttctattatatgataataactgcagcttctgctatgataattataaatactgcagcatgcttgtattcaacgtgtgtgaataaacatattctttcattagcctttttctttatgttcatgacctcagttcaattgtttggtagcgcagcagagctcttcaattgaagagctctgctgcgctactctcctctgttgatttctatttttctttttccaaaatgagtgaacaacaagatgaatctctcagtgttcatagcccatattacctacatcctagtgaaaatccggcaattgcactagtttcgcctctactggactcaacaaattacaattcttggagcagatcggttctcacagccttgagtgcgaaaaacaaggtagaatttgtggatggttcccttcctcaaccagcttcgaatcatagattaaacacagcctggaaaagagcaaacaacatggtggtttcatggctggtacactcagttacaacctccattcgtcaaagcatattatggatggacaacgcatctgacatatggaaagatttgaaagcccgatattcacaaggtgatttgcttcgaatttctgatttacaacacaatttagcttcaattaaacaaggagacatgaatattactgattactttacaaagcttagaataatttgggatgaacttgagagttatcgaccagatgttgtgtgtacatgtacttctaaatgtcattgtgatgctcttgttgaaataaagaaaaggaaagatcaagatagaataatggagtttatgcgtggtcttaatgatcaatacaaccatgttaaatcaagcatactaatgatggatcccttgccaccaattaataaagttttctcttatataactcaacaagaaaaacaatttgccagttctaatgctcttgacaatctgagtttgatcaatgctgttgttaatacaagatattcttgtagctactgtggtaaaaataatcacacagtagaaacatgttataagaaaaatggtttcccacctaattttttttccaacaatggaaataaaggagatggaggtagaagttttagtaaaggagggacaacaggtagaaataacaatggtaaagtttgcacttattgtggcattgctaatcatacagtggatgaatgctacaagaagcatggttatccacctggtcacaaatactataaacctccaggagtttcagtcaacaaaatccaaggaatttcagtcaacaatactgttaaggaagcagaaaatacttcaaattcagagattggtgataatggtcaagatattaaaatcactcagcaacaatatcaagcactcatgtctctattggctgccaacaataatggttctcatggatcacaggttaatcagattggtacaagttctgctcatacatcaaacataggtaatgtactatccattgtttgcaatattcacaaatctgaaggtgtagcatggattctggactttggtgctacagatcatgttgcatcctcattggcctattattccacatacagagaaataaaacccataacagttcacttgcctactggtcaacaagttatagctacacactctggaacagtccaatttactgagtttttgcacttagaagatgtgttatatttaccatctttcaatttcaatttaatctcaatatcaaaactggtttcttccttgaattgtcagttaaccttcttctctaattcatgtttgattcaggatataagcagccagaggatgattggtacagttgatgtagtggatggcttatacaagcttagagtacctgctgccaattcagttctcaagccaagcaacaattttatttctgttaagtctgtcctgtcatgtaataaagaaatcattgatatttggcattttcgtctaggtcatccttcatatgataggatggaattgttaaaacaaacttatcctatgctgacttgtaataaaaactttgtttgtgatacttgccatagagcaaaacagagaaaactttcatttccaaatagtaattcatatacctctagtcctttctctttcatataggtagatatttggggcccttgtgctacaactgctttaaatgggcagaagtattttcttacaattgtggatgatcacactagatttgtttggatttttattatgacttctaaagctgaaactcaaactcatttacaaacctttgtttcctatgttgagaggcaatttaatacaaaggtaaaagcgattcgatcagataatggcgctgaatttatcatgagacaattctatcatagtactggcataatacatcaaacctcctgtgttgaaactccacagcaaaatggaatagtggagagaaaacatcagcatttgttaaatgttactcgagctcttctttttcagtccaaattaccaccaattttttggtcttttgctttacaccatgctgctttgcttatcaattgcttaccaactccattccttaacaatatatctccctttcaaaaattatatggcactgcttatgacatttcttccttgaaagtctttggttgcttatgctacactagcactctcactaataatagaaagaaacttgatcctagagcttctgcttctattttcttaggcttcaagccctacactaaaggatacattacctttgatctttccactagagccacagtggtgtctagacatgtcattttttatgaagactgttttccttatgcctcttccagtgcttctcaatcttttcccacatttcctgtgcattcctatcccaccatttatgaacatgctaaggatttggatcttccctcacactctagtatttttgataattctcagtcatctaacaattctattgatcattcacaattggatacttctgaccctgcaaattcaccagttattgttgctcctagaagatctgacagggaaagaatcagaccaaagaaatttgaagactttcacactacattcacatcaactgttactgatcaatcctcaggtgctctttatcccctaacctcagttttgtcttacaaaagtttatctcccacatatcatagttccatcatggctgtatccgctgaaacagaacctaagtcttttaaagaagcttcccaatcagataagtggatcaaagccatgaatattgagattgaggctttggaggctaatcatacttgggttttatctgaccttcctcctaacaaatctgctattggatgtaaatgggtttataaaataaaacacaagctgatgggtcagtagaaagatataaggcaaggttagtagccaaaggatatactcaggttgagggtcaagattaccttgatactttttccccagtggctaagataactactgtgagattattacttgctttagctgctgttaacaattggcatttaaaacaattagatgtgaataatgcctttttacatggagatcttaatgaagaagtttacatgcttttgcctcctggtctgcaatccacccaacctaatcaagtttgtaaattacaaagatctttgtatggccttaaacaagctagtagacagtggtttgctcgactgtccactttctttatctcacatggttataaacaatgttcttctgatcattctttttttattaaacaacaccttcagtcttctactattttactggtttatgtagatgacattgtcttgtcaggcaatgatcatctagagattacatccatcactcaactcttggatgaagtattcaaaatcaaagatcttggtgatttaaaattcttccttggatttgaggtggctcgcagtaaacaagggatcaatatttgtcaaaggaaatatgttcttgatatattacatgatacaggtatgttaggcagcaaacctgtttctactccaattgattatggtgtaagactacaccaacaatctggtacaccacttgatgatactgaagcttcattatatcgtagactcattggtagacttatttacctcaccaatacaagacccgatattacatatgcagtgcaacacttaagtcaatttgtagctcatccttcttcagctcatcaagaagcagcttatagaattctcagatacttgaaagcagctccaggttctggtatttttttctctgcttccaacattctccagctcaaagcgtttagtgattctgactgggcaggttgtcttgatacccgacggtctatcactggctgttcagtttatcttggtagctctcttatttcttggaaatccaaaaagcaggccatagtctccagaagttcatcagaagctgaatatcgggcactagccagtgctacttgtgaattacaatggttaacctatttacttgatgactttggagtcaattacactcgaccagctcttttattttgtgacaatcgctccgctctccatattgctgctaatcctgtttttcacgaacgcacaaaacatattgagatagactgtcacattgtgcgggagaaactacattcaggtcttatcaagttgctgcctattgcttctaatcatcaacttgcagacatatatactaaggcactttctccaggagctttcaagtttcttcagtgcaagctgggaatgtcgaacatacattctccagcttgaggggggatattaattatcctatattaactaagtttgttaggataactaaatatgttagagcagattaattttctgctatggttattatcataagtttgttagagtagattatctttatatcataatgactgcagcttctgctatcataaatttgttagagtagattatctttctgttatatcataataactgcagcttctgctatgataattataaatactgcagcatgcttgtattcaacgtgtgtgaataaatagattctttcattagcctttttctttatgttcatgacctcagttcaattgtttgttaccacgagcatgctagactcggctattcctttggctgcatctttaatttcttcagataacttcttgtgttcatcataaaatacatcaattggtgtcttgcccattctgtttctcattgttcttagttcacgaggaacattccactccacgaactatttacaaatcaagagtatatgtaaatgatggtatccaaatgcattacttaattaatctttcaattatcacttaataactagagaaaattacagcaatacctcctaagatctagtgtaattatactaacattttccgaggtattagagtaaggaatgaggagatgttactctaatgttttcaaacatataaaaaatgttaatgtaattttaatttcaaacttaaaaaaagttagtgtaggaaaattaaaaatggaattgcatataattacacgaaacctgatgagaattattgtaatttgctctaataactattagatattaaatttgtaagaaatacaaattcaaagttaaaatattttaaaaataaatcttaagggtgatatttattgttacaaatgcacttgtataatttttaattaaaattttctatcaatataatggctgtttaactattatgctaaagacaatggataaaaaaattttaaaaattgttacaataatcaacaaatacgacacacaatgatttctatttttaatttaaacttgttactttttaaagatttaaaatcagtctagctaacataagcctaaaatttgtggaattttaaatttttaaaataagattgatagaactgatcgatcccatgcgagtgaataaagaatggttgaataagaaaactaagcaaattaattgaccttgaaccatgcgagctctctttgcatttgaatgcttgctcttaaagtggacaaatcttcgaattcaactcgtggaagatgcgcagccaagtgtagaatgttgttaccttcattgtccacttctagtacttgatgcttttttaatgtccatggtatactattaaatattcttttttgtcgaaataccacaaccaagtgcagtaggttccgtccatttctgctgtccctttgaggcactaattcaggattcttgtcaataatcatcttcacagcctccacatttcctgattttattgcatcttcacgattctgttccaatgattcaacttaatttagtcaatacttcactatgtagcagcttccatagatctccttggcaaacattaatttctgttattagaataactcaacaaacatcaaataccattattagactggatatagataattaaggactaattcttaatttttatatagaacaaaaatatatataagtttctaaaatcaaaatcaaaatggaaatgatgtcaaataagatctaaattttagcttagaacacacaaaaaataaaaagccattttcaacttgtgaaaggttacctgaactttctgcttgtctcctcagcatattcactgctgtaacgtcctgttcatttcttgcaatggctatagttggatgtttttcaaacaaacgctttgccgaatctgttatatgcacaaattaaatagtacaaggcaaggtaaataaaaacaccaactaaattgaaaaaccacgtacgagttcatatatatctccttttatatatatgaaatcattgagaatttagctaggacctgtttggttttaaaggatgcatgatattacagtctttcagaaacctaatagtcataattaattatttcaactgattcagtgggttcgattcagtttgtaaaacttcataatatgtaaaagagaactagattacaaaaaggagaaataaggttgtttaattagttttagttttacacttacaaaacatgctgaacctaatggtcatcataaacagtcgttcaatatccttgaaatccattttgtcaagcacttcctcagaggacaaaatgtccaccatgctgtcgctcgtcaaatatggacctgcagccaagtgagctggaagcatcccatctgagtttggtattagcatgtcttctggcctcatacgcttaaccaactctttcacaatttcaagactgccttcccttactgctagatgaagagctgtgtttccatctgagtttggtattcgcatgtcttctggcctcatacggttaaccaactctttcacaatttcaagcctgtcgtaacgttgtgctgctagatgaagagctgtgtctccatctgagtttggtattagcatgtcttctggcctcatacggttaaccaactctttcacaatttcaagcctgccttcccatgctgcgtcatgaagagctgtctctccatatgagtcttttattatcatgtcttctagcctcatacggttaaccaactcattcacaatttcaagactgccttcccttgctgctgttggaaatcgacaatcacacacaaaacgtaaaacagaaaagagaatagagaagagagatatgacacagtaatttaccctggttcacccaatgtaggctacgtccagcttgtctgtactataatcacctcaccgccactcgttacaagtcactcggtttacaagggaaatataaataggattaaaaagaaaccctaacagtagctattcatgggccctagcccaaactactaataaaagtaaaatattacaaataatcagaggcccacaacaatacctagaagaagaagggttgtcatctgactgcgaaagatgagccatatccaacagctgctagatgaagagctgtgtctccactatcatttaacggcatgcgtaccatatcaggatatttttcaataatctgtttcgatttgagccactcttgccggcatattagtgtcgtcagatctactacttttaaagaacctgcaatcctttcaaacttcacattataatttctcatttaccctaaatatgtaaaaattcttttggaaacttgtctcaaattttgaattcctaataatttcatcatttgtaaattgaaatctagttgagaaattcgagattatgtagtcgaagggatccaatcatagatcacctttaattaagtttgaaaattgaatttcaatttgtgtttgaaaattaattctatgatgataagtaaaattgtttttgagagaagtaatttattttttcttttcttcagttgacaaaagctaattgatcataacatgcgacttatacttatttatactcatactttaaaagtgattctactttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttatctttcgaataaaataataattttctaaacccattgtttaaatatcattattataataatagtatagatatattttttttttaacgtcaagcgatttcaaattcattttttcaaaatgtaaaataaaaaactcttaagacatgatctctgaaatgcaccttgttgtgaatgcaatagtttaaagtataacttactcagctcttctggagtcatttcattcactcctctactttcatgttttggtgtcggtgagtttgttgaagaggcaattggagtttggtcatgactttgattaggagtatgatctggtgttggtataatctgaattttgtggtcatctgaaacttcgatattggagtccatgatttaattctagggaaaatgaagtgaattggatacctctctgaaattccctgttctatcgatgttgcttctttctttccagcctgcgaagcctgaacacatattatatttggtggtaaaacaagagtccttaattagttttccaacttgcacttaaaataattatttccaatatgacattttgtggattacagcaatgttaattcaatctgttcaacatttcaacacttgagttttcaaagtgaataaatatattcattaaatttgttaacataaaaaaaaatattcattataaaagaattatattcattaaatttgtggattagcgagactcactattcatgacactgttaattaaagtactctcaatttaatattatcttcgttgtacaatgataggatatctttacacacctaaaaccttcaagttcctactcttatattgttgacgaaaactttctgccatagcggtggttatatatttatccaacttccgttgacgcatttaattatatgattatatcctaactctggtctttttatactagttataatcaattaatccaacaaccattgaattcaaagctaagactagatgcattttattatcggaatatgtataaatttattaaactcactccaacaaccattgaattcaatattaattcactcttttatatcctaactctggtctttttatattagttacggacattttgattcaatatatttaatagttatgttggtaattgttgttatgatatttttttcatttatgttaaatatgttattttactaatgatataaaattaatgaattggtaaatttattgtattttttatttttattgactaaaacttaaatttttatcttttaaaaaataaataaacaaatttttgagcgttctatgcatccaaaaaaaaaataataataattacttatccaacacatttttataaatttaaggaagaagcaggctataatgggagaggataatcgatctctcactgtgagaaagtattttatgaccatcaaattactttgtgttgaattgtataatttaaattttaaattaatattaagatttattaggttgttacaatttgttatcatatttcaatatttgggaattaagattagatcaatttgttattatcccgtattattagcattttgttattgaatttttttatcttatataagaatttgagagaaaatatatgaaagagaatggaagagtccatgaatgaaaggagttatttatgaaaactctactttttaacactttgtcctcctatttcccgtacccttttcctctttctccttctcttcttttccattcttcctctcttcgtcttagcggcaacggtggtgccatgacggtcgatgatagtggggatgttgattcgtcgttgcctgaccgttgttctgctaaaagatttcaacaagagaaaaagcatggaagacgaaacagtcacaaagtttgatataactattgtctcacttaaacccaaattggattcaattgaacgaacccagattttagtctcccaaagttttgagcttttttgtattttttgtgtacgttgattttttctcaagggtgccaagttacgagtttgtttcttgcataaacgttgtttctataccattttactctcaattttgagtccaattcgggagaataaaagacctaagattttggttttgaaaatcagatgacattttttatgacaatatgtgattatatttgaaattgcagtttcaaggaaattattgtaccattgatttataatatttgtaatctggccttgttttctatgtttagatatgtgatgggtggtggcgcatggtcgtggctccaccgccgtagtgaccatctatggatggtggaatagggaaaaaggaggaaagaaagggttgccaaaaattgctttctgtgtaggttcgttgtcggagacaagaaaaatggaagaagaaaggccaaaaaaatgaaatgctgccgccagaggtgatttttggcaatggtgcacagtggctaacgacaatggtgatgaataagctagagggataaatcgagaaagtcaagaagaaaagaaaaaattcatccatgggattaaaatttgataaatctaatggtagaaattcactttatcattaattggagacctattacactctcccacactagactgtgtcagattatggattaaattgtacattttgaaagatttaagactaaaaataatattaaacgaaattaaagagtctaaacatatattttactcaaaaatatttcaaatcttgctttgaattagttgtttgacatttgatagtgtgtttcatactaaattatcccacatgcaagatataactatatatataatatttatgatctaggatttaaatcaaggataataagaaccctaaatcctaaattataaaccacatggaaagaaaacgactttgatatggtgtatgtgtagtgttgtgaactcggcaagtataccggtcgtacaagtaataaagtggtaaaagaagggatttgtcgttcccaacgaggattgtttggccaattaaattataaacttaatcgataagttggacgataattgaattgaataaattgttgttgtgtgtgtaataaataaactaaagctaaatgtgaacattaactaatatcaacagatgattaaagagatactaatatgtatggaaatgtagctagggcaacccacactcaatgtgcctctctatgaaataatattgactactatattctattatccaagctattcaactaatgtgctattcttatattgactaagctttgatgtctcttccacttagttctttaacccaccatccaaccctaatatcttagtgatcttaagtaagttaagcattaagcaacacataaatgagttcagttgcaagcacccatccctatgtctaggtgatgttagcaagttaccacacttaggtctgaaactaaagcccaatatgtctattgtgaacttgagttctaagcttttacctaggttagctaagtctaggcaagagaaggaaagagaaatacaaagtgcagtaaatagcttataataaatgaacaatagcattcaatacatcccaaggagatttacattaagtgctttggccctaactacattaattgctcagccaaacctcataatgggtggttgagctacaatattgaacatgcctagctggagcatagaagaagaagaggaagaaggaaaccccactttggtcttcaacctccaagccctagcaaagcttcctaagcttccaagaacctttaatgtgtgcttcttagtgccaaaaaaaacgtccattcccttttgaagctgagttatttataagggacatgtgaaactcccaatttgcccctgagaagcctcagaaattacaagatgcagagttacacgcctggggcgtggcttcccacgcctggagcgtggcttggcagagaaattttgagatggaggcagcttcccacgctggaggcgtggatgtccacgcttggggcgtggcactccagggagaaatacacttgcagaaagcttcccacgcctggggcgtggctacctctggttcttcagtgccttgaatcaagcttcttcctgctataaatatgtccaaattagcacaatgcatggaaagaaggcattcatcaacattgtacataattctatgcaattctaagctatttatcaatgattctggggttttagaagcttgaaaaggaccatatgctggatgcatatcaaacaattcccagatttagatattgctgtcctcagcaatgaacaaaaagtttgaataggaaagtatggatcaagtcttcagtgatgagttgcataaaacaagcttcaagtagagaatgctacaaatgactgattcacaatcaacttcagacaagcttttcaaatccatcaaacaatgagacccaaattggatacctctcacagatgtaaatttcactcagcactcaagtgtttggggtattataaactctcaatccatcactgttctagcattactataaacttgatcttattctctagttcctaaagataagaaacataaacacatgcaaagttgatcaaaaggtcttgaaaggttgtaacttggcttggctaaaaggtagacaaatttggaaagtgactaaataataatcgagattggaatagcatcaacttttccattcattcagattttccttcattttatttcactacctctttttagcatttctttttctttttcaattctttttttattcttgtatttttcctttttgctttcaattcatttcaacccaacttttgatttttctttttccgtttctaatgcttttcacctgaattcttttctttcaaccacaattcacataattcacatttgcatcccaatctcaaccaaggtgaggttatattagtggtttacattgattctttaaaaggtgtttgaacaattaagtctcaggctcaaggggctagcaagggattaataatttcagggaaagctatttggctcaagcttaaaagaataaagttgcctttatcacatcaacttatgcatgcatcagagagaaatgaatcaagttctagtgtactatcacagtgaggcatccctcaaaataaattaactgtatgggctcaaacctcactggctatggtatcaagctggactcatgatgatttcaaatcaaacttgttttccatctcatactgaactcagtcatacaagcattcaactcaattcctgctctatacacaatcaatccagaattcatatcaccaagacttcccaaaatatcaacacattcactgatttggcaattctaaacctgagtcatgctatgctttagcaaaattctaaaagtaaaacctaaactctaaatcaattcttgtattcctgtacgcattgatcacaaaaaaaaaaaaaaaaaatcaaaaatttctgcctatattgtatctgttcacaattcacaaaaagaacttgttcaacaaaaagatctatcattcacaaaaagaatttcaatcaactgatgcttgtttcctcaattaacgcgaccaattcccagatttaaaaccaattgctgccctcagcaatgacgctattcaaaaacgcatagggatgaacaaaatgaaacgcgttactagaggaaacaaagtgaaaaccatacgcattcatcaacagcagaagtatccaagtgttcaaacacatgcaccatatcacaaaaggtgcgcaaaagtctcaaaacagtaaagagtctaaacataaagcagaaactaaatataagcataaataaagatagagttcagaaagtgggggtccaattcagcgaggctgatcatcatccatggggtctgcgtcaactggtggtgatgatgggtatgcaaaagcaagcgcaggaggctgcggctgatactctgtggggtcaatggtcaaccggcggcaaatggcttcaatcatcctttgttgaccttcaaacatctgctgttgagtttcaagcatcgcctgctgttgcgtacttcacggcaagtgcaccgatcgtttaacaagtaataaagtgagtaagtgagttatcgtctccacagggattgggataattttcacaataatgtcaagaacgtgattgaaagtgaaaacagaaaattacgcagaagagtgttgttgattgattggttgtggtgttgtaaaacagaatttaaacaaatgcagtaaattgagttaagtttaccaatgagagatgaattgtagtcaggcgcaatcccttctgagtcttcctcttttacttgactgattcgttaaattaatttgaagtgcacatatgataaatctttcctataatcgtgaaacctagataactagcgagtcaaccctttaattgatcaaagaaccctaaacctatagcgattctgtcgaattaagcatgtaaagaatatatcatatggggtcgtgttatgattgttcagaaaataagtctttctaaattagtgaatccctaattccttagtgaattaaccctttaacctgaatcgaaaacctaattccttagtgaagtctatcagtttaagcattcaaaagaccatattatagtttctgcacctacgcatccctattcctaggtgatgaacaaatgttactctctatcagttcagaaattagaaccccaacgtccccattgtgaatcctaaccctatgcacttaaatgaagtgatcaatttcaaataagaatttggatgaagagaagataagaataaaacaatcaaaacataaatttatttcaataccagtcaattacagaggaattctcatcagttcatggcctttctacaataagaggtttagcctgccataggcctcaagaacaccaaagctgttgaataattcatgattttccttgcgatccttgcttcgatgcttgaattctagggtttggctggtgaatatgtgaagattcgatgatggataaaaagctctcccactctgttcagaggcctcctatatatactaatgtgtaattaaagaaagaaactcaaaagataatcttatttgcaaaacaaatcttttaaataggaaacagaatcctattcacgctatcagcgcgcgacgccacgctaatagcgtggacttctcaaaagtatgacgcgattagcgtcgcctctcacgctattagcgtgagttattcgagagttcagactgcttccaggcttctttcacgctgttggcgctgatttcacgctagtagcgtgatctgttcgagacatctggctttgattcgtcttgttgacgctaatagcgtgaggtttcacgctaatagcgtgacttggtcgagagctcagctcctatttccctttatatggcgctggtagcgtgaattctcacgctgatagcgtgagacttcctttttagttttctctctttgcttgtttttcctcctttttacctgcaaaatactcaaatgatattgaaattagttttaaacaattagaatgctaaactagcctaattctattctaattcatatatatttaattaaaatctaagttaaaactatgctaaaaactagatgtgtttgcaacacatcacctgctgagcatccaactttgcgtgcaactgctggtagctctcagaatcctcgtagatatgctcccggtgtgaggcatggctggaaggagaagcatgagctgtgggtggaggagaagcagctcgtggtgatggtctgggtatatcatactgaggctcccctagaccctcatgtggtggtggtctaggactgcgggcatccatttcttctcgggagagctcagcagagcggaggagttgctcttgaagaagacgcttcacagaatcttggtaagtgtgcgacgtcagagcggggcccggttgtacatctttaggctcatcctcggggatctccaacccagcatgcatacataaatgggagataagagaggaatgcgctagatggaagcgactgctgctgtcaagtgtcatttgcagaatccggttggaaagaatatatgctatgtgtaaattctgctcctgcatcaatacaaaaagcaagcaagtcctctcaacatttacatctgacatgttagttgagggaatgacggtgtgatttatgaattgatgccagaaatcagcttccggagtcagctctgagcgcttcaacttttctgggattgcctccataccagctttcattttccatgaagaaaagcgtccagtgatgcctcggcgaagctcatccgctaattgaggcatatcatctctgtaaagagccttgccggtgcctggaatgggctgcatgatatcatgtcgtctggcaaagtcacagccatgggtacgggtatatgaagtctggagaaagctttcaataaaggccgggtcaaatgggaccttcactcctcttacccagctgcgtctcctttcttcaactgtatccctgtccacattggccaggaactcttttaatatagaactggagctcggttctgggaagctaactaaggtgtgccattgatgcctggtaatcacctccaggataggtgaatcagctggtagaccctcccatgctatgcgcttttctggaattatcttcttgggcagataccatttatcgaatctctcttggtgttcgcgggaccggaaacgaccatcatcataatcagaagttcggggtcgcttgctgctggcccctgtggttgccttttgctggcctttgtccacttgctttccctgaaactcagaaaatttccatgtaccatatggtctccattagactttttcaaaaatagcaagggtataacatggacattcataattcccagatttatttgcaaccatatcattagcaattataacacaacatcacatatggttgcaaggaatttcccattcaaatctttacaacaagcatgccagttcagaatttgataatcaccttaagctaatcaccatgacaatagaacaatgaacaattaaacagatcataagcttgaggcaaatgaagcaagacagatgtaagaacagaccttgcacggaattcccagatttaatttcaacataatggttcacacgaatggtatccaattcaaagaacttgtgctcatgttcattacttgaaattaaaacctaggcattcagactctaactcagaattcccacatgatcattatagcacaattgcaaaacagagccctatctacgctaccattcccagatttaattcatatagtatctcacacaatgtgcttcaaattgggcaatgaatccagtgttcacagtttaatggtaatgtatttggtctttcaacaagaactctcaactattaaggcccaaccatcttatttgtcatcacattgtcctagggtttgattcacaatttcagaatagcaagccaaacaatggaataaacatgaaagcctttaagaaccctagaacaattgaattaaaccctaaatatagtatcccaatgcatgctaataccatgaaatctatcaattaggcaatgagttgctcgcaaccaagtaaggaacagacccacatcaacagcttttgacaagatacagttctcatgaaggcagagaagcatttcagtacaaaaacacctccacgcctgaggcgtgaaatcccacgcctgaggcgtgggctgggaaaaacagaaactaaaagctgcagcaagggggtgaatgttatcccttccacagcaaaggagcaacccaaaggaagagatgcttaccttatcacgacccatgttgatgcaatgcactggaaatagaagcttcaacttcaaaagccagaaaacccacttgaacgaaaacgtgaaatggaaatggggaagagagagaactgaagtggagagtgggagacagagagaaaacagaaatgagagagagagagagaaaaaatgagatgttaatgggaaaatgagggttatggaggtgagttaataggagttatgggaaataggaggagtggggaggtgaggggttagggttgtgagtgagagagagagagagaaggaattcgaaaattcaaatttaaaagcactgcagaactcccacgcctgaggcgtggaattccacgcctggagcgtggcataccaggggactttgaagatccagaaggcttcccacgcctggagcgtggaacttcacgcctggggcgtggccttccaggggtttttggtgttccaggcctctattcacgcctggggcgtggccttcccacgcctggggcgtgggattccagtgatagaaggatttccaggaggttttccacgcctggggcgtggcatcccacgcctggggcgtgggcttctagggaaggcttttatactgctttttctggtttaataggccatatgtgaccccctaactgctactcatgaaaatatgcttttaagcttgaatgaaaatgaaaagaaactagcaacacaaacaagattaacatacaaaaggtaaactatacattctatcctaagaacatgaaaacacagaacaagaaaacaccattgagttgcctctcaagaagcgcttgtttaacgtcacgagcctgacgtttaatcctctaaggattaggggagctcaaagggattgcacttgcatccctatcaattggaccaccatggtatggcttcagtcgccatccattgaccttgaagggttggttagagtccagaggagagatttctatggtgccataaggaaaaacctttaccactacaaatgggccagaccatctagacttgagtttacctggaaacaaccgcaaccgcgagttgtacaataatacctgttgacctggagcaaactctttgggatggatgtgcttgtcgtgccatttcttagttttctccttatagagctttgcgttctcatatgcagcaagtcagaattcatcgagttcattcagctgcaacaacctcttctcagtagccttggcgagctcgaaattgaggaacttggtggcccacatagctttatgctctaattctaccggaagatgacaagacttcccatacaccaactgatatggtgacataccaattggtgtcttaaaagctgtccggtaggcctacatagcatcatccagcttctttgaccaatccttccgtgagttcccaacagtcttctctaaaattcttttcaactctctgttggagacctcaacttggccactggtttgtgggtgatatggtgtggccaccttatgggttaccccatacttgttgagcaaactctcaatgttcttgttacagaagtgggtgcccccgtcactgatgattgctcttggaaccccaaaacgagtgaagatgttcttccttaagaaagcggacaccacctttgcatcatttgagggcaaggctgcagcttcaacccactttgacacatagtctacagccaccaaaatgtattggttggagtaagacttgggaaagggccccatgaagtctatgccccaaacatcaaacaattccacttctaagatgttgttgagtggcatttcgtccttccgagaaatatttcctgtcctttggcatctatcgcagctctccacaaatgccttagcatctttgaagatggtaggccaatagtatccactctgtaacaccttatgagctgtcctattgcctccaaagtggcctccatagctagaagaatggcaatgccacaaaatccttggcacgtcaaactcagccacacaccttctaattatgccatcagcacattggaagtataagaaagggctgtcccagtgatatctccgtgcatcatgcatgaatttcttcctttgttgccaagtcaagtcatctggaattgctcccacagctttatagtttgccatgtcagcaaaccatggtgtagcagtgatagccatcatttgttcatcaggaaatgactcattaatctccaactcgggcccatcttgcagattttcagcttgaattcttgataagtgatctgctactttgttttccaccccagctttgtcttttatctccaagtcaaactcttgaaataagagcatccaacgcagtaagcgtggcttagcatcctgctttgttaacaaatacttaagagcagcatggtcaatgaaaacaataactttggacccaatcaagtaaggcctaaacttgtctaatgcatatactatggctagcatttctttttcagtggtggcatagttaacctgtgcctcatttaaaactttgctagcatagtatataacatgtagaagtttatccttacgttgtcccaggacagcccctatagcataagcgcttgcatcgcacattagctcaaatggtaagttccaatcaggggctgtgagaactggtgcagttgtgagcttttcttttaacacattgaatgcacttagacaagactcatcaaagacaaaatcagattctttagtcaatagttggctaagaggtctagcaatcttggaaaaatctttaatgaacctcctatagaagccggcgtggcctaagaagctacgcacactattgacatttgtgggaggtggcaatttttcaatcaacatgagcttggcctcatctacctcaattcctttagaggagattttgtggcccaaaacaatgccatcacgcaccatgaaatggcacttctcccaatttaaaacaaggtttgtttcttggcatctttgcaaaactttagataaattagacaagcaagcatcaaagcaagaaccaaacacagaaaaatcatccatgaacacctctaaacatttttcaaccatatcagagaaaatagaaagcatacacctttgaaacgttgcgggcgcattgcacaaaccgaagggcatccttctgtaggcaaatactccaaatgggcaggtgaaagctgtcttatcctgatcttccggtgccacgggaatctgattatagccggaatatccatcaagaaagcaatagtaagcatggccggctaatcgctccaacatttgatcgatgaagggaagagggaaatgatccttccgagtcgcatcattgagtcttctataatcaacacacatgcgccagcccgtgatggttcttgtaggaatgagatcattgttgtcgttctgaaccaccgtcactccgcccttctttggaactgtctgtaccggactcacccaagcggtgtctgatatgggataaatcatcccagcatcaagaagcttcaccacttctttccggacaacttccttcatcattggattcaaccgcctttggggctgtcgaaccggcttcacatcatcctccatcagaatcttgtgggtacaaaatgagggattgatacccttcaaatctgaaatggaccacccaatggcagatttatgtgcctttagcactttgacgagctttgcttcttcatcttcagacaagcttttgctaatgatcacggggtatgtgtcattttctcccaaaaatacatacttgagggctgctggaagttctttcaactcgagcttaatttggtgccccaacctcaatgtctgtggcctttttctctaacacctccatggctacttcctctgactcttcaataactgccaattcctgggtgtttatcaactcttccaattcttgctccatagatacatttgactgaactaaatcatctagcacatccaactggaagcaatcatctttatccattgggaccttcatggcatcaagtacattgaaggtgatagactcatcaaacattctcagctccaacttcccttcagccacatctatgatagctctagccgtagccaagaatggcctacctagaagaacaagtatttctccttcttccatgtctagaacaatgaaatcagctggaaagataaacttgtccaccttgaccaaaatatcttcaatgaaaccactaggtcttctcaatgatcggtcagctagttgcaaagatacccgagtgggctttaactcagaaatgcccaaggatttgcatatagagaggggcatcaagttgatgcttgcaccaagatcacacaaagccttccccacattaacattacctatggcaataggtatgttaaaactccctggatctctaagcttcggtggaactttactctgaataatagcactacattcttcagtcaaaaccacagtttcacattcttggagcttatgcttcctagaaagcaattccttcatgaactttgcatagtttggcatattggccaaagcttccgcgaatggaatgttgacctgcagctttttaaacatatccagaaacttggcatattgtttcttttgattttgctgcttcatcctcaagggataaggaggcttctcaaacctggaaaagtccaggggctgcttaggctcagctgtgaccttctcctttcctttgttcttctctagttccttggagctgttgcaatcttttggtgttgcaagattttcaggttctgcagaattttctgctgcagaattttcaagtgatgcctcagcttttggagtctcattctcttcctctcttggcaccacttttaccttctccttaggagcgatgacaatcccactccgagtggtaatggctttagcatgctccctaggattgaccacagtatcactagggaattggcccggtggtctctcagctagttgccttgatatttgaccaatttgtgtctccaaattccgtatagaagctccttgattcttcaaatgagacctagtctcattcatgaaagcatcggtattttggatgtggtcattggttgtcttggctagctgcaacatggctctttcaagctcagatggctccttgggagggatgggtggtggttgcaaataatggttggatttgtaatccaaaccacccccatgtggtcttctcggatagttacttccactcccagaagcttggccataatttctctgataaccttgtggtggcctttgatcataccatactccattgacttgaatcggatcagcccccaccaaggttggacatacattggactcatggtccccttggcaatattcacacacagccatgcctgctttgattgacgaagcttgagctttggatacctctagcttgtcaatcttagcattgaggatggctagctgttgtgataaaagtttttgctcagccaacattgcgtctgagctacccaaatggatcacttctctctttggctgacttgctatgctttcattctcagttctggccaaagagtctattaaatcatgtgtttgggtagctgtttttgatctgatagagcctccagctgctccattgactatcagcttggattccggtgataatccattaaagaatatcctcaccttcttcccctcgggcatgtcatattgagggcaacgccggataagctcttgaaaacgattccaagccgcacataatgtttctccatggagctgtgtgaagttggtgatttcattcaccaagcggttatatttctccattgagaaatactgagcgaagaatcttgccatcaactcgtcccaagtagtgatgctgttagaaggctgacgatgtagccacctgagtgcttttcctttcaaggcaaaaggaaagaggcgaagtcgaatggcatcttctgtcactccttgatggcggatggtatcgcaaatcatcataaagtgatcagcaaagtcatgaggatcctcatcatcctcaccaccaaattggttcttctccaccaagctgataagagatgggtggatgtcaaagtgatgggcttgaattggtggcctgactatgctgggcgctggatggacaaacaatggagcaagaatattctccattaattcatcctccggccttggctgctcgttgttgttttcagccatgtctagttcctcttcaaatgtttcttcttcaagaggttgagaactagacccttctgcttctcttcttaacctcgttaacctccgattcctcctcgcggttttctcgatttcgggatcaaactggagttggtcagggctaacggtacctcgcatatactctagaagcaggtcagtaacaaaagaaatccaatcttaaagataaaaatttataatgaatttggctaaaacaatccccggcaacggcgccaaaaacttgttgcgaacttggcaagtataccggtcgtacaagtaataaagtggtaaaagaagggatttgtcgttcccaacgaggattgtttggccaattaaattataaacttaatcgataagttggacgataattgaattgaataaattgttgttgtgtgtgtaataaataaactaaagctaaatgtgaacattaactaatatcaacagatgattaaagagatactaatatgtatggaaatgtagctagggcaacccacactcaatgtgcctctctatgaaataatattgactactatattctattatccaagctattcaactaatgtgctattcttatattgactaagctttgatgtctcttccacttagttctttaacccaccatccaaccctaatatcttagtgatcttaagtaagttaagcattaagcaacacataaatgagttcagttgcaagcacccatccctatgtctaggtgatgttagcaagttaccacacttaggtatgaaactaaagcccaatatgtctattgtgaacttgagttctaagcttttacctaggttagctaagtctaggcaagagaaggaaagagaaatacaaagtgcagtaaatagcttataataaatgaacaatagcattcaatacatcccaaggagatttacattaagtgctttggccctaactacattaattgctcagccaaacctcataatgggtggttgagctacaatattgaacatgcctagctggagcatagaagaagaagaggaagaaggaaaccccactttggtcttcaacctccaagccctagcaaagcttcctaagcttccaagaacctttaatgtgtgcttcttagtgccaaaaaaatcgtccattcccttctgaagctgagttatttataagggacatgtgaaactcccaatttgcccctgagaagcctcagaaattacaagatgcagagttacacgcctggggcgtggcttcccacgcctggagcgtggcttggcagagaaattttgagatggaggcagcttcccacgctggaggtgtggatgtccacgcttggggcgtggcactccagggagaaatacacttgcagaaagcttcccacgcctggggcgtgggatcctacgcctggggcgtggctacctctggttcttcagtgccttgaatcaagcttcttcctgctataaatatgtccaaattagcacaatgcatggaaagaaggcattcatcaacattgtacacaattctatgcaattctaagctatttatcaatgattctggggttttagaagcttgaaaaggaccatatgctggatgcatatcatgtagtttacgaaaaagataatgtggattaattatagtgtgtttaaaatttggctttaaaattatgaatgagctaatgagatgagtcaaacttgattttatctaaaactagttaaatggttcatgacttgcacagtagtaattttacaatttataatttcttacaatattataactttttaagataacattttttttttatttttatttttattatcattataataaatatttatgacaatttaataaaaccatgataataaaaaaattaccataattattacaaaaacatattattgttaattaaattataatccatattatctcatgtatatattatttttttactattaaaatatccctaattaaataagagagaaatcacattaacatatatatttagaagagagagaaacattaatgataatagtatttttgaaaatatattattttagaataaatttattattatcggcttaattaattatttttttagttttgatgaattagataattgagtctcataaatagaaatggaggtagtatataatatagtagatatagcatatagtagattttgcatgtttagttattttaatataatcaaatttaattgaaaaaattatgatggagttgaagtaggaataataacttctacttataccaaaataaattctagttagattttgtctaatttactttcaaatcaataatctcatatgcatctatatgtttttttattgatttaaaaacatgattaaaattcttgctatattaatttatagattctagttgttatatttttttattgaatgcattttatctaatttatttttgtactcctaaccatattagtgtgataaaccattttataaaaggaaatattatatttcagtttaattattggtagatttgggtttaattttatatatatatatatatatatatatacatcaaaataactaattgtaatagaaaatcagtgtatatagacattcaaatccattttgatcattacaccatcaaaatcaatttaattcaaacaacactctctcataataaatcccttttctgatgttgatggagtatggtttgaccctctgttttattcatcttttcatcaatgaaattttatagtgaatgttatggtgctaatgagattggggtgtcaatagaattgaaagatgaatcccattagctagacttttgctccccgtttcttaaaaacaccatttttctaataactattatccaaacaaaaattacattactgtataatcaattctaaccataattaattatgtaaaatcatttgggtgtccgcctttaagcatattctacaatcatcttcttgcctaaacttgaaccatctacctatagtgctcttaatttcttacaaatctccaatttctccgcccgaccatgaagttgttggagagcagccacaaacaagtgtcaattacaaacattgacaaaccgctaacctatacaaaagcagaaaaagaactgaacaaaaacaactttcttgaatgaatcaacagcttaatattacaagatctgaaattaaatatccatccaagatcttattttgaaacttttatatacattatgatgcccgggtaaatccataaaattaagcttttcacaaccattaaattcattaacaaatcatggctacatctttgaaaattggattacctgttttttttctaattgtatgtgcctgtttgctcttccattttctccgtatagactacgaatgttacagtggaacatgagtagcaatatagagaaaaataaatgtaaactaagtgatatgcgcctagcataagctatttttccaagcttaatggagccataatataccttagagtgaataataattgctcctttttgttagaattgagactaaatgttccaaagtgatgctttccaacaaattatgcttatgactggaaaaagtagctaaagaagaaggtttcagcgcgaacagcgccaggtaccgcgccatccgcgccactagtcacgagccacgcgactcgcgccatatgcagcgcgagtagcgcgaatagggctctgcaattaaagaattctctggatcttggcgcgaccagcgccacatgccacgcgaaccgcgccagaacctttctgcaattgaagatctctctggattttgacaccatccgcgtggagtatagcgccatccgcgccaaatgttaattgtaaagtccacttccaacccacgtgagtcgcgccagtgcgacgctatccgcgccagtatcagcgcgactagcgccatgttccacgcgatccgtgcgagactcgatttctgcagattatcaaagctgtcaagggaaaacttggggtttcacttccccaagtataaatacaagaacccacttctgaagaggggactttttggacgaaattcactgaggaaaagctagagagagagcttggaagcttagctagggcttggggttgtgagtgcaagtgggtttcttcccatcttctctaccttctccttgcttgtgtatcagctgggcatgcttctttttgatgtaccaaggcaagccatgattaggtttggctagtttcattttgtagctagggccaaacacttgatgtaaacttccattggaatgtattgaatgctattattcatttatcgaaagttattttactgcactttgtttgaatgttgtctatctctttcttggacttgatcaatctagttaagagttaagagttagggttcacaataggaatattggggttctagtcgtggaactaagtgtagtgacttgctttacattatctagagatggaaatgtatgcttgtagcttattctagtgtttgcttaatgcttaaccctaggaaggtgactaagggattagaactttcaagtgggttgaagagttatttcattgaggaatcgatgagtaattgatatgcgacgaacacaaccgctgaataacttagataatcgaatgtagtgaacaatacgcgttcattggaaggaatcatcgagtgtgggtgccctggctacgctttctttacattgtcacaacttaccttgtttgctcataacttatctttatgttttaatcttgcctttactttatttactcaacaatcaactcattcttttgcaaacattttatttatccaacttttggatacaagtgataatacaatcggtgcactaatcctcgtgggaacgataacttctcttatccctttattacttgaacgaatggtatacttgccgatttcgcaacactaagtaaatgataggataaaacaaaacaagagagatcaaatttaaggttttgtgtttgtttgaggaagatattcgcacacgaggttgcaaccagtattacaaaaaccatcttcagattggcgattcaactagtcaaatacatgtctgaatgtctgatcagtaggctactggatcgatttgcaattggtcaatagactatcttttagtttctttctattcacaaactcttttttagcttagcataacctgaaactaattcttttaaactaattttggtttagtttggttcacaggaacaatttggtgcaatctctctgttttggttcagagcaccaaaacagttcagttccattcaaagcccaagtatagaaataaattgtatgcacttgtgtgaattttccatgcctttctttaatttgctgacataaggggattagagcttatcatcagcaaaaaagggtttatcgtctgaggaattgaagtttagctaaataagagaaattgaatcacataattaagacgaccaagagattatcttagggtggaatcaagggaatttcaacacctaaccatttttattaattgatttttctagtacagtattcaattgtgctcttgtttctttcaattaaataaaaaagtccaaaaattcctaattgtttatctcttaaatcaaaagagtaatcaataatttgatttattgatgtattgtgtattgttgataaaccaaattttttattgatacaataacttctccttattttatcaattgtacaactagtacacttgtagtattctcaacaaactacaacaatatactggtagaaggtgactcagttgatcttaaatttaataaataaggcgtgttcagtcacgcacaatttagacgtgtttgacagctccatatttgtaaatagtttcaaaacaactccaaatttgtaatttttttgcctgcttttgggagtttctatgaattatctctgatttatgattatttgtgtttatgtattgcagctaaagcactagagttatttctgcaagatttgtgtgatcgaacatatgagataactttgaggaggggggcaaagactatgaatgcttttcatttgtctatgtcaagtctgttcaaggtggttacaaggctgcaggtttctttcttttggaggtcggttattactatgtacttataagaacatcagatccgcaattctaatgataatatgcacaatcaaacaatttccttcctgtgccttctatttatcacatgcacaaacatgattagacatgtaaatgacagctgcagaagaaaatgttgggatggtcttgcttttggaacatgttttttgttctagtgtttaccttcactttccagtttctaaaatgtctgagttacttcacttgcatccttgcctttgcagaaaccagtgtgtgcagacttttaatgtctttgattttctgaaagatattgtcagcaaggttccggatttaggctgttctgttgcaactggtgatgatcatgctgtcactaagaggaggtttgtgctctggttaatactcttgttacttggaacaagttttcagtatgctgaactttgtttactttatattaggaaagttgccggagatgatgataatgacagcgacgaggagctcaagagaaataagaaggtaatttataaactgtattcaattacttaatcagtggttagcttaaatttttcttgtgtgattgaaccttttgctgagtaattatctcttgtccatgcacactgtgaaccttttgctggatacaaaaaaatttacttcagtcaatagggaaacccgctagtggcttgtgaatgcaagtacgtctaaatgtctaatagtctgcgaggctaggccccacttcaacttaaagcttactacacaaaggaccaaaactgtctcgttttctgaaaacttttgctgaaaactatagaattggcactaaagaacctggcagctgtttaatattaaatattatctgaattatggaacttttttttcccatgattttcacagccagagcctggacataacagtggcagaggaaggggtaggggcagaggtaggggtaggggccgtggaattagaactgtagatcaagagatgagttcacatgccaagtgggaagatgattctgatgtattgaagcagaatgacaaccacactcaaagcaatgaaagcatggaaaatgtgccggaacctgaagtagttaagcagagttttccactaagcaaactggctgaagtgtccattctaaattttgacttaaatttggacccagatgaggatatggattcattagacacaccaatttctgtcccaactagttcatctgcaaaatcagtgtcagaagagaagcatgaggaataccctggatgccccttgtctgaaatggaaaaaatgaccattgatcccattcaactagccgacataaatggaaggattgatgaagaagaagaggattatgatgaagaaatgcagatgaacctgtgttggtttattcattacttctcatataggcccgtcattagaatgttcttatggggaattagagtagattttgtaggagcagtgttagatacttactccttagtagtttaggaagattaggagggatagtgcattgaattgaatactctccttataacccttgttttaggttaaaataaagtggagatatagattgttccaattagacatagccacttgccagtatagtgatgacttatgagaaattttaatctcatgtaggtattgcttatggtaggcactacattcagattttgggtgtgttatggctcaaaattttacgaggatgcctatcttaatcacacttgtatctagcggaactaactcactgctccggcaacatgatttgcatgcaaccttttgaatttttggtatcttgaacttattgcacgatgagacaagaggaaaagaataagacgttagacggattgaaataaataggaaataaagtgaaaaagatgtgttgtttagatgaataaaaatagaaaggaaataagtgtagaaattcattatttatgtttgttttggacaaatgaaagagaaaatactaccagatgaattgtttgaaaaaaaatatacattttttttaaattatttccatcatttttctaacataagattattaatttttattatataatatacttattttttttttaatatttataagcaccactaatggctgctctgtaaaaccaatctcgtctcagactaatttgtttaagtttaaaataagtgattttaaaataaatattttttaaataaacacttatttaataaacaaataaaattgatcaaaataagaagaaaaattattttttaagcacacacaatttagataaatacactaaaaaatacaaaattatttattttattaaataaatatttttttcacgaataaatttaaacaaatttatcaaagaacctcacttgagttacaagcacgagttagactaattagtacacatgtcagataattataaataataattgaataatttgaataattaactactaaatgtgggacttgtgtctataccatgaggtgaaaattatctaaggtagaacataaactagattttgagttcaaaatctaatcttcattagatctccaaataaaggaggtgagcaaatcttaaacatagaaaataagttcttatagaaggtttctcaataactgcacattattcaattttctttttcttttctctctttctaatagatctcaaaatgagatatactattaaagaaaaataggaaagatcttgaaaggtatttaatcttacatgacactatagaatttacaaaaaagtgatcttagatctcaatttgagatctattattaaagattctcttatgattttgaatctacttagaatactaacaagaaagacgtgaaactaaaattccaaagtacaattaacttggtcctagctctagatccacatgcttacatgcctccgtccctgattggagatgtatgaagtttatatttaatatggataagtcctaggaaacacataatagctgggggtcaatctcaaagtttggaatacctataatttcttattagggtcaatctcaaagtttggaatacctataatttcttattaaaatgccaaactaaatggttcttaacataataacagtggttgtgacatatactaggataggaaacgcacaatatatagtcttaaattcaaagacgagcttaattgtttcacaaacaaataacacagtgtggacactgtcacactgtctataaatatcaagatacagaaaatgaggagaaagttttagagtttgccagtgtctataactatgtaataagttactagagttcggatggaagataaaatctagaccataagtgtttgtcgaaaaagctaaattgaaagagaagaaacagaagaattgggaaaacccccattgaagccactgcataagaaatccacttggaagtgtgatcaaatatcagaaaggaagctgcagtgaaagccacaaccatagcagcaactgagataataagtaacgcacgccgaaaagtcaagctcggatgcagtgatgtcaccaatttgcgatcgttttttgcgagtcttgatgaagtgaaatttgacaagaaagatagtagagatgcagaagaagtgaataatgcgactgcatttgttaagatgaagacagtaaaccacgcattgttcttgttgtcacctggaacagtaagagcagcggcaaatgctaccgtagcaacaagtgctgccacaaccatgccatactcggctattcctttggctgcatctttaatttcttccgataacttcttgtgttcttcttgaaataaatcctttggtctcttgcccttgttgtttctcattgtgcttaatttatcatcaacatacgacttcactaactatttatcaatcaagagtatatgtcaatgatggtatccaaatatatatttgcgcatgcattggttggcataaattaatgtcaatgcataactataacttaattaatcttttcacttttttttttttataagcaaaatattattgataaagcttaaacaatatatgccttgattaatcttttaattacaacttttttttgaagaaatcttttaatgacaacttaataactattacatgctaaacttgtaagaagtacaatttcaaacttaagatatattttcttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaactagagggtaatgttgaatattgttacagatgcactgctagtcttctacccttatcctgtaattctcagtaaaatctttcttactacttattgattgttcaaagacaaaatttcaaaaatattttagtaatgagcaattgctattttaattataaacttgttacttttgaacacttaaaattaaatcaatcttgttaagaaaaccctaaaatttatgcaatttttaaaataagattgctcgaactgatcctatacatataaaataaagaggaagatcgcaacaaagaatgatgggtaataataagcaattaaattgacaatttgagctctctttgcatttgaatccttgctctaaaactggacaatgcttcgcattcaagtggcagatgcgcagcaaagtggtgaacattgttaccttcattgtcctttgccagttgtaaatgctctattaattccgccagatccattcttttaagaatggtatcttttcgatatagaacaaccaagtgcagtaggttccgtccattattggggtcctttatgctcagtagctcacgattgttgtcaataagccaaaatacagccttagcgtttcctgattttactgcatcaaacagcactgtcgaacatatcaactccatatcctttttgttttccatttttctaacttgagtccataattttttaagcaattccagactcgcttgtgatgaacctcctgtattgttgtcctctaatttcgtgtccagcaataagcacagttgattggtccaagcaatgtttaaaatgaaaacaaagaaaaaaaaaagttaaactaaaaatttattcttatatgaaacacaccattttttttttgtttttatatctattttaaaaaatatatataactttctaaaataagaatcaatatggaaattatgccagatacgaagatctaaattttagtttaccacacacataaaaaataaaaagtcattctcaacttgtgaaagcttacctggaaattccggtgacttttgcgccagcatatgcaatgctgtaaagttctcttcatttcttgccatggccaaagtacttggatatttttcaaacaatttcattgccacatctgttatatgcacaaattaaatagtaaaactcctactaaattgaaaaatcacgcacgagttcatatatacagacacaagttaaacaacatattaattaattataataagatcgagtaaactacaaaaacacttcttaaagtttcttaaaattacacacaataatatccctcattttttacacttacactaaacctctaattgtttgaaaaacattatattgaaatctcttacacattatattaatcttccttaattgtttgcaaaacattacattggatggataagggagctgctgtaatgataaaaaaagttggagatttattgtaaattcaatttaatcttataaaaatccaaagatgcggcctccggtactagctgggttctaaattacttggggcaaaggacaaagtatgttgaaatttatatcttgatctgattagggtttctatcaaaatttgatatagatcatttgaatcaagtagtactttttagtctcttttcattaattcccattacctgttaattagaaaagctagctacgtataattgctaaaataaacaattatatcattcacgttaattactcataaaaaactactataaaaattaattttaaataagaaagcaatgagaaattggacctgttgggttttacaggatgatatcacaatctttcaaaaacctaggggtcataatataagtatttctacagttctctactgatcattaaatttgttattgagttatggtcaattaaaccgaatgacgttggaattgaaaacctatagcttatgtatgatcagctcaattggttcatgaattgagattgcatgtttagttttacactcaccaaacatgttgctttctatggtcataaaaaacagtcgttcaatatccttggaagccattttgtcaagcacattctcagaggacaagacttgcaccattttgttgtcgccatataaagcagccaagtgaactggaagcctctcttgtgagtttggtattagcagttcttctgggttcataagcttaactaaccctttcacacaagtaatgttccctccatatactgctacatgaagagctgtgtctctcttctactatcatttaacggaatgcgtaccatatcaggatatttatcaataaccgtttgtgcttctctccactcaccccataatatatgtttgcacagatcatcttttaaagaacctgcaatcctttcaaacttcacattataacatttaattcctttatttaatcttaaccacatattatttgcaaaaaagatgaccctttcttgtttaccataaatgtgtagaaattcttcatatagaaattgtctcaattttgaattcctattaatttcatagtttgtaagtctctgtttttcaagacacccttattgaaatctagctgagaaactggagatcacggttatgtttggcccaactttttttctacttagaagttatttttagctaaaaattagaactgaaaataaaagataaaaactgtttgtcgtttttattttttcagcttaaaatttctttttaaattaaaaattgctttataaaaaaatttaaaagttttaattttatttaaaagtagttatctcttccaaaaaaaatacacttataaaattaaaaaaaattgtataaattaactaaatttatataaaattactttgttaaattaaattatacaataagaggaatgcatttaatttaaaaatgtgacatattactaggatatatatatatatatatatatatatatatatatatatacttcaaaggtgattctacttttatctttcaaataaaatttatttttctaaacctatttttaaaatatcatccgtataatataaatcaatttttttaatgtcaaattcaaaatattcaaaatccaaacttaaaaactctagagtgttgtgtcaatgcaatataacttactccgctcttctggattgatttcattctccactatatgttcatcagcagctgaagcagcaactagagttatttcactcacacctctgctttcatgttgcggtgtggccgaggcaccagcagctgaagtggcaactggagtttgttcatggctttgactaggaatgtgatttgatgatgatattataatctgaattttgtggtcatctgaaacttcgacattggagttcatgattttctaaagaaatgcccgtgggatgtgtgaggaggacacttaattgtcttgttgttgcggtacgttgatcagtgtctgagtgatgagggagcggtttctgagcaatgttatatgcaaagagagtgaagctttttgagacttaagggtggtgtgtgtgtgcctgcagatgtggctgtggactatatataatttataggtagtccggaacaaatacaatcaatatcttcactgatttttatatgacaaatagtgttattatttttttataaattataaactttgaatgcatgttatgtagacattggttgagattatgaatacaaagtgattccacatacactatttaattaatttctcttggctgacaggtgtgccatgacaaaaaaaaaaaaaattgttgagcccacatgcaaataactgtactgattttttgagtgaggaaaaagcaactgcagtagacacacggaagacaatcatctttacccaaaattgttaccttacttttttgtttttgttgttatctttttttgtatttttaatatttcctgtaccttttgcatttatttttttgacttatttttatccattttcttaggcgaatttgaaatgttgctttagattagttgtaaagctaagcaaattgctttgttagattcttctgaatgtcattctttttcaccttccgagaaagccagaagaggtcctttattcctttgttaaaactactgcttccaagtattccatactataattctggacgattaaaagataacaaaattcctttcccactaggtgggggtggaatatatggataaaaattaaaaagcctcaatgtcttgttataaatcatgccataacactaatcattcaaataaaactaatatagtttttcttggtctctccctatctctaactaattaatgcgactagcctccatttgatcctgatgtacttcctttattcggattctatagcttttctccacacatatgtgggaaatagacaccaaggtcttatgtggcccaccttgtgttcttacattagccttgacccccattgtacatgtctctgattgctcgaatatagacaatatatatacctttctgtctccacaggaccacagcctcgcgtaatacagtacacgcatacctttattttttttatataacttaagttatataaaaagtacgtacaataatctcaaattcaaacagaaccttggttaattatttcacaaacaaattatacagtgtggacactgccaccttctatataggactttaagatatgaaagtctttgcgactaggttgctgaactttgggcatacgatagtatctagaccataagaagtctaaacggttaaattgaaagagaagaaacagaagtattgggaaaacccccattgaagccagtcataagaaacccacttggaagtgtgatcaaatatcaaagaggaggctgcagtgaaagccacaaccatagcagcaacggagataataagtatgcaactgcattggccttttcacctggaacagtcagagcagtggcgaatgctacggtagcaacaagtgctgccacgagcatgccagactcagctattcctttggctgcatctttaatttcttcagataacttcttgtcttcatcataaagtacatcaattggtgtcttgcccatgttgtttctcattgtccttaattcacgaggaacatccatgtctactttctatttatcaatcaagagtagtatatatcaatgatggtatccaaatatatatacatatatgcgcattggttgggatcaattaatgtcaatgcacaacatgattaatcttttaattaccacttaataactattactagttaattttttaagttaagatattaaaaataaaaagaattgatctagcttgaacaatgcgaactctctttgcatttgaatggttgctctaaaactggagaatataatgctttgaatttaagtagcagatgagcagctaagtgtagaacgttgttaccttcattgtccactgctcctactatatgctctatcttttttttaagtatactaaaaaaaatgcttctttttccatatagggcagccaagtgcagtggttccgtgcattgttgaggtcccttatcatggtctagttcactattatcgtcaagaacccaactaagagcctcatcattttttgattttagtgcatcaaatagcactgcccaagttatcaactctaaaatcttttcatattccaactgtttaacttgagcccatagttttttaagcaattccagacccgctcaagcaccttcattgctgtggtcctctttcatgtctagcaacaagcatacatatatagttgattggtccaacaaatgtataacatgagcataaagaaacaagttaaattaaagtttggtcttatatgaaacatcatttttttgacaaacacataattaaataaataaacaccattctcaaccgatcatgaaagcttacttggaatttctgaaggctttcgcaccagcatatccaatgctgttaacttctcttttgcctcttcatctgttgcaatggccaaatcagttagatatttttcaaataatttcattgccacatgtgttacatgcacaaattaaatagcgatggtggattgcatatgtacaaggcaaggtaaaactccaactaaattgaaaaaccacgtaggagttcaactagataaaaaaaaaaggatggttggttttacacttaccaaacatgttgctgctaatggtcataaaaaacagtcgttgaatatccttataagccattttgtgaagcagattctaagaggacaaaatttgcaccattttgttgtggccatataaaacagccaagcgaactggaagcatcccatctgagatgggtatcagcctagaacgattggatctgcaattttaatgataatgtgctcagtctcattaaatttccctcttttgacttctatgtttcacatgcacaaacatgattatctacagaagaaaattaaatgttgggatggtcttgcttttggaacatgtgttgtttgttctagtgtttaccttcactttctagtttcgaaaatgtctgagttactttgcagaaaacagtgagtgaagacttttaatgtctttgattttctaaatgatattgtcaacagggtttctgatttaggtggttctgttgcaactggtgatgaccatactgtcactaagaggtttgtgctctgattaatactcatgttacttgcaacatgttttctgtgtggtgaattttgtttattttatattaggaaagatgatgataatgacagccacgaggagcccaagagaaataacaaggtaatatatcaattacttctcagtagttagcttaaatttttcttgtgtgattgaaccttctgctgagtaattatctcttgtctatgcagactgtgaaccttttgctggtaacaaaagaatttacttcagtcattcagtcattcgggaaattcacaagttgcttcactgacttgcgaatacaagtacatttaatatatagtctgtaaaccttactatacaaagaaccaaaactatctggttttcttaaaacttttggttaaaactgttgttgtaattgagcaaactttttgttttcatgatttgcacagagcctggacattgcagtggcagaggaagggctatcaatgtcagaattcagaagagaagcatgaggaataccctgaatggtccttgtctgatatggaaaaaatgacattgatcccatgcaactagctgattaacttaaatggaaggattgatgaagatgaagaggattatgatgaagaaatgtagatgaacctgttttggttcagaaagttataattgagaactagagtagaatttttaggagtagtattgtacaaatccttagtggttaggaagattaggagggacaggacattcaaaactttagtccttacaacctttgttttgtgaaaaagtggagatatagattgttccaattagaaaatagccacggtattgttatttgagaaattttaatctcatataggttacagtaggcactacattcagatccttaaacttacggattttgattttgttttagctttgattgtggcgttgtgtatgtaagtcgatctattattgtatcaaaaaacgtgtcgtctcgagtacaatttgagagcaaatatgcagagcaaactcactgatccgaccacatgatttgcacttgaacctttttgttatcttgaatttgatgagaaatgagataaatggaaaagaaataagagggatagaaataaaaatttaatgtcaatacactaacaatataaaacagtttttaggattttaaaaattatcatctaataataaattatcattttaaaaagtcaataaatttatattacataatgaatgatgactagatgactgcgtaaattttttacactctcaaatacatcactcttctctgcaaataaacacaaaataagatgaaaaggatgtaccatttaaatggatagaaagaaaaagaaaaaattgtaaatttttatttgtttgaataaatacgagactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacgctaaacatttctccctccgtttcacgtcttttagtgagaaatatgatttggttaggactcattaattataatttcatttctcattttctaacacattcaatcaagaatatttttttattactttatttctcttcattttaattttatatttattataattttattgtatatagtaattcttttcaaatcgagtaggattgagtctccgtgaaaaatgaatgtgtagtaaaaaaaactttttctgcgttatgatttgctcccttcaccaaccgcatggtaggaaggggaaaagctttgacgtgggttatgcagcatagtctcaaattaaggcgggaacaataagaaaggtaatatttcatgacatagaaaatgtagaataatctcaaatttaaacacaagcttcattgttccacaaacaaataataatacagtgccttaaagttatgccaatgtctgtaataagttagtcctgtttggacaaacgataaaatctagaccacaagtgtttgtttaaaaattcaaattgaaagagaagaaacagaaatattgggaaagcccccattgaagccactgcataagaaacccatttggaagtagtgtgatcaaatatcaaaaaggaggctgcagtgaaagtcacaggcattacagcaacggagatattaagtaacaaacgcccaaaagtcaagctgggatgtagtgatatcacaaaatcgctttgtacgaatcttgatgaagttaaatatcgaaagaatgtgagtaaagacgcagaagaagtgcataataagaatgcatttgtcaatatgaagaaagtaaaccaggcattggtcttatcacctggaacagtcagagcagccgcaaatgctacggtagcaacaagtgttgacaccagcatgcctgattcggctattcctttggctgcatccttaatttcttcagataacttcttgtgttcatcataaaatacatcaattggtttcttgcccatgttgtttctcattattcttagttcacgaggaacatgccactccacgtactatttacaaatcaagagtatatgtaaatgatggtatccaaatgcataacttaattaatctttaattcaattatcacttaataactagaacaaattacagcaacacctcttaagatctagtgtaattacacaaacatttcctgaggtattagagtaaggtttgaggggatgttactggaatgtttttaaaaaatataaagaatgttagtgtaatttttcaaacttaaaaaaagttagtgtaggcaaattaaaaatggaattacatataattacacaaaacctgaggagaattattgtaattttctctaataagtattgcatattaaatttgtaagaaatacaatttcaaagttaagatatttcaaaaataaatcttacaggtgatatttgttgttacaaatgcacttatataatttttaattaaaattttctatctatatattggctgtttaactattatgctaaagacaatggtaacaaattttaaaaaattgttaccataatcaacaaatactacataaaatgatttctacttttaattaaaacttgttacttttaaaaatttaaaatcagtctagttaacaaaagtctaaaatttgtggaatttgtagaattattgtaatttgctttaataactattacatattaaatttgtaagaaatacaatttcaaagttaagatattttaaaaataaatcttgcgagtgatatttgttgttacaaatgcacttctataatttttaattaaaattttctatcgatctatatattgcctgtttaattattatgcatgctaaagacaacggataacaaattttaaaaaattgttacaataatcaacaaatactacatacaatgatttctatttataattaaaacttgttacttttaaagatttaattaaaatcagtctagttaacaaaagcctaaaatttgtggaattttaaatttttaaaaaaagattgctagaactcatggatcccatgcgagtgaataaagaatggttgaataagaaaaactaagcaaattaattgaccttgaaccatgcgagatctctttgcatttgattgcttgctcttaaacttgacaaatcttcgaattcagctggtggaagatgcgcagcaaagtgtagaatgttgttaccttcatagtccactgctcgtactagaggctcttttaatccccatggtatactattaaatattcttttttgttgaaatagcacaaccaagtgcagtaggttccgtccattttcggggtcctttattgtcactaattcaggctgaatttcaataatccattgcacagcctcaacattttctgattttattgcatcaaacagcactggcgacattatcatccgcttatgttccaattggttaacttgagtccatacttttttaaatagccgaccaccttctgatctctcgcccttcatgtctagtaagaggtatatatatagttgattggtccaaccaatgtttaacatgaaatgaaacaaacaaaacttgaatttaaattttattcttatatataagaagcaccattttttttatctctttaaaaaaattatatattttaatccgtacatgaaaaaaaaattgtaagatattttttcacatgtggctcatgtgttgccaaacattaatttgtgttattagaataactcaacaaacatctaataccattattacactggatatagatatttaaggactaattcttaatttttttttatataaaacaaatatatataactttctaaaataagaatcaaaatggaaattaatgatgtcaaataagacctaaattttagcttagcacacacacacaaaaataaaaagccattttcaacatgtgaaagcttacctaatttttttggagactttcgcgccagcatatgcaatgctgtaaggttctcttcatttcttgcaatggccagagtagttggatgtttttcaaataatcgcattgccaaatctgttatatgcacaaattaagtaaaactccaactaaattgaaaaaccacgtacttagttcatatatatctccttttatatatctgttatatgcacaaattaagtaaaactccaaccaaatctgtctcgacgtattgctagatgaagagctgtgtctccacttgagtttggtattagcatgtcttctggcctcatacggttaaccaactctttcacaatttcaaggctgccgtaacgtactgctagatgaagagctgtgtctccacttgagtttggttttagcatgtcttctggcctcatacgcttaaccaactctttcacagtttcaagactgccttcatttgctgctatatgaagagctgtgtctcctattgagttttgtattagcatgtcttctggcctcatacggttaaccaactctttcacaatttcaaggctgccgtaacgtactgctacatgaagagctgtgtctccacttgagttttgtattagcatgtcttctgccctcatacacttaaccaactctttcacaatttcaaccctgtttttctgtgctgctagatgaagagctgtgtctccacttgagtttggtattaggatgtcttctggcctcataagcttaaccaactctttcacaatatcaaggctgacgaaacttactgctgcatgaagagctgtgtctccatatgagtttggtattagcatgtcttctggcctcatacgcttaaccaactctttcacaatttcatccctgccgtaacttactgctagatgaagagctgtgtatccactatcatttaacggcatgcgtaccatatcaggacatttttcaataatctgtttcgatttgagccactctttccagcatatatgtgtcctcagatctacttttaaacaacctgcaatcctttcaaacttcacattataatttctcgtttaccctaaatctgtaaaaattctcttggaaacttgtctcaaattttgaattcctaataatttcatcatttgtaaattgaaatctagttgagaaattcgagattatgtagtcgaagggatccaatcatcaatcacctttaattaagtttgaaaattgaatttcaatttgtgtttgaaaattaattctatgatgataagtaaaattgtttttgagagaagtaatttattttttcttttcttcagttgacaaaagctaattgatcataacatgcgacttatacttatttatactcatactttaaaagtgattctacttttttttatctttcaaataaaataataattttctaaaccagttgtttaaatatcattgttataataatagtatagatttattttttttaacgtcaagcgatttcaaattcatttttttcaaaatgtaaaataaaaaactctaagacacgatctctgaaatgcaccttgttgtgaatgcaatagtttaaagtataacttactcagctcttctggagtcatttcattcacccctctactttcatgttctggtgtcggtgagtttgttgaagtggcaattggagtttgctcatgactttgattaagagtatgatctggtggaatctgaattatgtggtcttctgaaacttcgatattggagtccatgatttaattctagggaaaatgaagtgaattggatacctctctgaaattccctgttctatcggtgttgcttctttttttccagcctgcgaatcttgaacacattatatttggtggtaaagcaagagtccttaattagttttccaacttacacttaaaataattattcccaatatgacattttgtggattacagcaatgttcaatctgttcaacacctcaaccctacagttttcaaaagctttttaagttgaatgatttctaaatttgtaatattaattctttttcaaagagaataaatatattcattaaatttgttaactgaaaaaaaattatacacattaaattgtgtggattaattagcgagactcagctatcataacactgttaattaacttactctcaatttaatattaactttcttctttggacaatgatatgatcgatatctttacacacctaaaaattaaactacacaaactatcccttaagttttgtgaaattatataaactttcttatacttttttaaacatttacaacaatctcgcttatagttataggggcagaaaaaacatgaaaaatttgtataatttcatgaagccctataaaaatggttaatgcaatgtattcttttttaaatgtgtaatggaagaaacacttacgcatagagatgttgcgcaaattgactcagtaaaaaaacccaaaccgaaccaatttattcaaattattttgaccaattcattttaaatccaaatagccaaattactatagaaaattggtttgaaatggaattagtttaaaaaaaatagtttgaattgaattgattttgaattagttttaaatcaattttaaaattagaatagttttgaattgatatttgaattattttaaaaaaattgatttggatgaaaaccaatttgattaatcgaaccagttttataaaaatgattcggttaattgaacaaacttttttacaacagtgcaattcatcttttttaaaccagttcagattaatcaagttgatttttttaactcccctatttacggatgtattgtgctttcagaacacctatttagtaaccaaaatatgaatgcatattacgtaagtacatgcaaaaataattataaaacatgtgattaggagcatatagtacattatgggacatttagataaatataaatgtatttcaaaattcaagtattttgtaatgatattttaaatgtgttctagaagagatattacagaacatcttacggagagatgttctttcagcacacctattccataaccaaaatatcatactttcaaaatgcatatattatgtaatatattaaaaaataataacggaaagggcattttaaacatctaacgaatatgtattgttcttctgacatacgtattaacctatcatatttcccagaatgcgtattccacaatacattaaaaaataattacggaacatgtaatctagaaataataatgagaagtattttaatttgggagtcactcttaagtgagaaaggaggtgtaacgtaagttaatttttataggatgcaggaagaagagaaaagagacaactcaatgttaataaagagagaaaaaaagaaaaggaaacacacaaaagaaactagagtggaccaactcaaaggattatgaaaggaaactagcatgcatcacagttatatatatacaaattaaaggttgaaggaaagaaatcatgcccaaatgtcttgttaatgaagaacgatggagataaagaaatgcccatgggatgtgtgaggacgacccttgtcttgttgttgctgtacgttgatcagtgtctgagtgacgagggagcggtttctgagcaatgtgttattatatgcaaagagagtgaagctttatgagacataagggtgtgtgtgcctgcagatgaggctgtggactagatataatttattaggtggtccggaacaaacactatcaatatcttcactgttttttatatgacatatagtgttattatttttttcataaattataaactttgaatgcatgttatgtagacattggttgagattatgaatacaaagtgattccacatacactatttaattaatttctcgtggctggcatgtgccatgacaaaaaaaataaatttgttgagccaggcccggccctggggcagggcgagcggggcgcccgcccagggcccaaatttttttatcgatagtttaagtaaaaaataaataaaaaaaacatatattaggggttcattttatgtgttagggatccatttttttcattctttagttttaatattatttgtatttcaaaaaaattgtatgttaggggcccattttttccatcccttagttttaatattatttgtatttcaaaaaaattgtgtgttaggggcccatttttttcatcccttaattttaatattatatttatttcaaaaaaattgtgtgttagggacccattttttccatttcttaattttaatgttatttgtattttaaaaaatttgtgtattaagggcccatttttttcactttgccctgggccaaagaattttcaggaccggccctgtgttgagcccacatgcaaataacgtgtactgattttttgagtgggaaaaaattaagcaactgcagtagacaagggaaaacattcttcttctttacccaaaattgttaccttttttgtattttaatatttcctatacctttttcatttatttaattttttacttatttttatccattttttgaggcgcatatttgaaatgtactttagattagttgtaaagctaagcaaattgccttgttagattcttcggaatgtcattcttcaccttccgagaaggcagaaggggtcctttattcctttgttaaaactactgcttccatgtattccatactaacaaaattcttttcccactaggtgggggtggaatatatggataaaaattaaaaagccacaatgtcttattataaatcatgccataacactaatcattcaaatataattaatatagtttttcttggtctctccccactacaaaaaaataatatatttgtggtggctaaaaaatctatttctgacggctaaaaatcgccacaaaattaacttctgacggtcaggatcgactgtcagaagtagcaatgtcagaaaacattgtggcggcttttagaggaatgctggtaaatatgctagaaaaattgtgacagttaaaagccgtcacaaaatttattttcactctttttttacttttcacgttttctatttctggcggtttagaaactgttagaaagtgtttttttcggaaaaatagtattatttttataaaaaaaattatattcatatttctctagttttaatcattttcattagttctataattatttttaattcctatttgattaagtataaaaattgatataatgtattaatttctattctctcaaatttcaatactataataattattgtaattattaatattacaacgtgtcattaaaaatatcaaacataatttacaacatgcactgcaaatatttttaaagacttttgcagtctgaacaacactaatgatgcaccccattttactacatgcagcgcaaatagtttcaagacctgtgacagatatcaagcactacagcctacaggttcatatcactacatgactatttggaaggaaccatatagagtgcctttttcctcttttgtgagagagtttacactgaatttaggaagccaaatttttataaacatccacaagctccatcatgagatcatataagttcgaaaaggcactatccaacaccattccagcaatagaagggtcttcaggtccataaagaagactacatcacaccaaagtaaaagggaatagtcaattaaactagagatgtggatataaggctggctcataattacatgtatacagagtaaaggtaagactataagatactaaaaaatctagtgacttggccatcaaattttttaaaaattatgtattcaaaaggggcaaaataagctattttcttcttcttttccaccaatttctcaaaggatccagctaagtgctaatgaatgccctaaaatcattggttaagaatcaacgaaaaaaacttttattggaaatcatgatggaagtacactgataatattttttcccacaaaatttccacttttgatttcttaaacagtgtcctaaaggcatttgtttgcattctcctttctcaaataattaaaaaaaaaaaactcccataggaaggcctcaacagttttgcccacacatacacatacagagatagagggagaaataaaacttaggtcaagaaattatactattgtaggggtatgcatagcaaatataaagtatcaaagaagcagaaattcataaaaacaatatcaaacaagttaattgggagattacgtagtaacaacacccattacctatccaagatatttgtttgttgctcctcaaatgacaccctcatcttgaaatcatctttctaccactcaaaggaatggacacgtattggtagtttcagaaaatatggaatataaagaaactcaacttaataactgatgtgttgctaacacatcttagtttttaggttgtatttagttagatttcaatcaataatcaagaatttaggttagaattagttaagtttaattaattgttgttattatctcatgataacactaaattgtgcattttagaagcaaaaagaggagaaaagaagcagagaagcaaaatttggaagcctcgaacacatcgcgcgatcaacgtgggatttcatgcgaatcgcgccaagattccaagtccaagcctacagctcgaacagatcacgcagttagcgtggatatccgtgcgggtcgcgtcagaaggccaagaagccaagtccatctcgaacaacccacgtgagtagcgctgttggccacgcgaatcgcgccagaaacacagaagcaagctattccattcgaacagatcacgcggttagcgtggtagctcgcgctggtagcatcagaacgactgaagagaactcaagattcgaacatctcacgcgagtagcgtgagatgtcgcgccaggattatttggtttccttatttaaaatatttggcacgaaattaataaagattgagggctttgttaccttaattaaaaagaaggacgaaaaatagcataaaaagggggcctttggactgataaaaacaatttttgatacacaaattcacagggaagcacagtggagaaaagatcaaggccagaatttgaagaagatttatgttcccactttctttgtacttcttgaggttagacatgaacatgtctggctaagttcttttattatggtgaaagccaaaaatcaatgtgaactcatctataatttgattggtgttaatatgagattattatgattgctttgttttactctactcttcatcgttaatatctttcttagaattggtcattctatttaagttcttaggattagaattcgcaataggaatgttggattctaatttctgacaggagtaaaataacagtttttatgataatcacagtgaaaccaagcaaagcgttaaaaaaaagatgatatgataatcaaccttgccatcagttagtatgagactccattatagttaattgcagaattggaggattatatacttatgagttcagactaaataaggaagaaatttccttgcattacatattaaattgttgacttctgttataaaatatagacaacttcgcattcagggagcactactacaaaaaacacttttcacgacgcaccttctaagacggttgttgaaaaaccgtctttgaaaaaatgcagtggcatttttgtaaataaatataatcattctaagatggtttcgcgaatttttatgaaaaaacaatttggaaagtgaattgactttgttaattttttttcttctgttttcttttattatttttaaaaggggaagcaattggttttgggtgagtgggattcggttaggcaacatttggaaacacattcaaactagcttttatgtgttatagggagctagaaataaataaaaattgagtgatgtgggaatgcagcatagatgggatcatggaacacattcaattcaaattcacacttgagtgactcagatgaaatcaaactaaagaagtaacaccaattaatgcaagaacacagtttggaacccttttggcccccacacataatggcaaaagacacaaaggaacaccaagccaacgtcacccatttcctcagttcaaacttgaaaaccgacaacagggaatttagcataaaagtcagaagaaaaaaaaagttgtgaatcctctctttaaccccaatgttcccacagtaacataacacaccaaatcctaatcataattaatcacgttccattatgtcaaatataaaaaacacacacctctttgcaacttaaaaactttaattaaaggggaaaaaaactgaaaaggaaaaagaaaaaacagattagtgaaacttcaattgaaattacctgaagtaaacgcctaagtggtcttggtgggccacgagaagcatgagatggtgccaaggtgtttgcctccacgccactttgccatcactcccgatactgattttgtacccagaaacaattagatccaagcaccatagttctggcttcttttgccaatcaaaggaatgaattgaccaaaaacatttgacctgtaagacatgaaacaagagaaagaaattacaatttcatactggtgatggatctttcaaaaataacaacagaaaagaagtagaagatatgtctttataggcaaaagaaaaacgggggaagtaaaaccctaatcgaacatgaatgccgaaatcaccattgagggagacattgtgcgactcaaaatcaacggagagagtgcagggagaataacctagctcctctacaatcgagatcagaggcaaaagcggccaaatcgaactctgagaaaactcgatgttcatgcaatgtatcgggcaacactttaactcttgcactgcgtccctttattgctcgaatttgagagcccctgattcatgcgagagagcttttgtggcaacgagaaaaccacttgaatgatgaacccttgctttttgacttttgagtaataacaaataatgtaattttttaagttggtgtctaaatgatacgaagatatgaagtgacacgggacataatgaaaaagtgtaaaagaacaaaaataaatagtaaaattattttcctttgtgacaatttataatgaccgtcagaaatattttgttagtaaaacataacttttttgtagtgccccggcccctatctctaactaatgcgactaccctccatttgatcctgatgtacttcctttattcggattctataacttttctccacacacatgtggaaaatagacactaattaaggtcttatgtggcccaccttgtgttgttacattagccttgaccccattgtacatttctttgattgctcgaatatagacaatatatatacctttctatctccacaggaccataaccttgcgtaatatagtacatgcatatctttattataacttaagttatataacaagtgttggacttaaatcccaatcaagtccagctcaataagaaaaaaatattagggttcattcttttgataggtcagcagctaacatttaacggtgaatccattttctaaagcagacaacagtattacgagggacatttctctcatactaaccgttggatcacgttcaaactttgaggaaatgttaataaaatttgtttctacattctgaccgttcggatcattcattgaagtgttttcaagagggagtgtttcaactgcaaacagagattaccaaaattcctgatatgttctgtcttgtttcgggcagtgatattgagaaaaagttatctctttgcttaaccgttgaattattctcaaatttggtcagtgtgttcctctcttgtagtaattcaatttgaccgttggaatttgtgagtggttaatgctggtggtagaaattaatttcgtagagaagtctattttgtatgtttgtctcttgtaatgttttggtacaacttttgttgaagttgtttgttgattgtaatggttgctgctgaaactcttttgtaatctcacttttttgatagtgaagaatttgagtggactccgaaatcggtcccgtgaattttacttctcacattgagaatgtttttcacattaaaaattgtgtgtattgcttgcataattgttatttgtgcataaattattttgtttgtgtaagatcattataacaggtccaagaaggtttttccctacaaaaagtacgtacaataatctgaaattcaaatagaaccttggttaattatttcacaaacaaattatacagtgtggacactgccaccttctatatgaaagctagtctttgcgagtaggttgctgatgaattttaggcatacaatagtatgtagaccataagaattcgaaagggttaaattgaaagagaagaaacagaagtacgtattgagaaaactctcattctcattgaagccactgcataagaaacccacttggaagtgtgatcaaatatcaaaaaggaggctgcaacgaaagccacaaccatagcagcaatggagataataagtaacgcacgcccaaaagtcaagctggaatgtagtcatttcactaatctttcaattatcacttaataattagagcaaattacaacaacactttatgaggtttagtaaggtttgaggaaatgttaatataatgtttttaatataagagatgttaatgtaatttttcaaacttataagaagttagtgtaggaaaataaaaaataaaattatatataattacacgaaactaaggagaattattgtaatttgctctaataactatacatattaaatttgtaagaaatacaatttcaaagttaagatattttaaaaataaatcttacgggtgatatttattgtatcaaatgcacttgcataatttttaattaaaattttctatatatctatatatagcctgtttaactgttatgataaagacaatggataacaaattttaagaaattgttacaataatcaacaaatactgcatacaatgatttctatttataattaagacttgttacttttaaagatttaaaatcagtctagtaaacaaaagcctaaaatttgtggaattttaaatttttaaaataagattgctagaactgctcgctcccatccatgcgagtgaataaagaatgtgttctgctcggtgagaacagaaatgtccaacaagtgttgttggatattttctataggatcgggctctctctcttttaagaagcctatgaactgaagcaacttaaggaagaagatgatcacagcagcgatacacacgaagcaattggtgtgcagtgtgtgccgtgtgaaagcaaaagagagagtcagaattgtatgtgtgtgtgtgtacctttcaccatgggatgtgtggtatttataggattcaaacctggactttgatagcagacggttgagccccatatcttcttccttgatatgtggagatattgataactgaaagataatgctcatatcttctattttctggtgattatcttctggtagttatgatgacagaccaatagagatttaaacatttgaattaataggacaaaagataatatatgtttatcttttatccgtaacagatgcccctcagcccggtcatctagcattctgggtggccgggatgtatcagtaatggagccgaccatgctttttgggaagaacttgagcaaggttgatcgatgtccgaaccgagattgttatcatccgaaccgatatgtccaaagttcgagccgaggtgccgatcgtccgaaccgaggtgatcaagacccgagtcgaggttatcaagacccgagctgagatgagtttttgtagcttgaccgaggtgagtgaatccgagccgagatggttttcgtctgaaccgatgttttccgaggtgtgagacgaggaaacaattgtccgaaccgaggtgagcaagatccgaaccgatatacacttcgcatctgccccttgccgaggtgatcgatgtccgagttcgcttttgtccctctctccttgtattttattctggtgctttatttgctctttgcttctgcgtcttttgcattctctttctcttttgcgtatcgtggctccaattgtcgagcgtctatttggccgggaccactggtcgggctctggccgggaccactggtcgggctcttagatgtcgttctgggatctttgtcccgacttaacaactgttaacgtatttgtaacatcattataagtgtaattctttcggccgagccgatgattcacccatgatagttacgtcggcttgatcagggccgagataatacgaaacaacgactaagcatttaaatttgtgcacaataattttccttataacaaggattttatcaaatttcttcgaagattacatgattttcatgatctcaatgactgatttgcgcgggttctgcgtctccggatcaactaatgagaaacacatgataaatctattggtctcacatgaccccattgacgggcttgatggccaactaaaggggaacacatggtgagacaataatccatgatccctatgacggacttaaagccaactaaagggaaacacacggtggagttccgtgatcccaatgactgactgaaagccaactaaaggaaaacacatggactatctcggctgtgctacaatgtcttggacaacccggtacggtcctttccgatttgctgctgtccttccttaaacctcggtcggtcccttaccgaccttacttgaggtatttcttccgttggttggctgcgttgcctccttctctcattcccaccgtgatgacgttgcactcgaactcgggctctgagaattcttcgtctttctcgctcctcttgtcatttcgttgcttattttcctgctgggctttcctcttgccgtggtgcccttgagttcggatcacgtattgtcgcagtttgccttctcgcacaaatttttctatagcatcttggagctcccagcactagtcggtcgtatggcccggtccgttgtgaaaatcacaataccgggaatagtccagtccttgtttgcttacaatcggaggaggtcggttgacttttctcatgtcggtgaaggcgacctccttccatatttggccacgtgggacggtcaacggagcgtaattgtgatacttcaactcgtacctcccgggcctgggatgagggtcgagactgctccgaggtgatcggcctgctggggtattcgctagatgtcggctggacggtccgacctgggaattctcctgtcgtcggttccttggcgatgagggttcttcgttttctctaggagccgagttggcgatttccatctgttccaattccaagtatttcttggatcggattctgaactcatttaaggatttcactagatccttatatatggacttagcaaggcgggaggagccgttgagcccggccgacagaaggtggacgtggactttctcctccaagccttgtacttgcaaggcggcttccttaaagcggtctaaataactctgcagtgtctccccatgctgctggcgtatctttcccaaggcaaactcagatttcggctgcttcttgctcgttgcgaaattcagcaagaacttctggccaaaatcttcaaaatcgtggatggaccgtggcggcaaagagtgaaaccaggtctgggcggccccggttagagtggtggagaagatccgagatatgatgggttcgtcgattccacggacgcacatctgcatatcaaactcgtcgatatgtacctgtggatcttggctctcgtcatacttggacaagaaggagccgtcgaaatcctccaggaactgagcatccactatttggtcgatgaatgggctgttattctgatgccctcggcgatacttccttcgatacgtgccgtcggcttggccgggatgacgggcgaattttctcatcggcctttcttccgttggcggtatcggcgttatagccgaggatgggcgaagtgcctcgtggtgggaacgagacgctcttccctgttcggagtggtcaacgggatctctctggtcggtcccggctgttcgggccgacgtcgccggtctcgatcttctagctgttgcatggggctggtcggcttctgcatgatcttccgtgtggtcggtattttgccgacgcttctcttcccgtcttcggttatcgtgatcctccaactgagcaatcagccgctggatgtcttcctggcgttggagttcataacgcttctccagattctccattcgagccaacaaggattggagagcgttctggatgaaacgctgagaagtttctgggtcttcttgcgcggccggtggtgtgttggccggcacctgcgttgtaggtcccgcacgagatgaagctgtgtgggacaatgcgtcttccgccaccgcgttctccggattcggatttcggggtggttcttcacgtccggcgttctggtgtcttctggtgttagccattgagagttggtgggattcgaagtttatcgttcccacagacggcgccactgttctgctcggtgagaacagaaatgtccaacaagtgttgttggatattttctataggattgggctctctctctcttaagaagcctatgaactgaagcaacttaaggaagaagatgatcacagcagcggtacacacgaagcaattggtgtgcagtgtgtgccgtgtgaaagcaaaagagagagtcagaattgtatgtgtgtgtacctttcaccatgggatgtgtggtatttataggattcaaacctggactttgatagcagacggttgagccccatatcttcttccttgatatgtggagatattgataactgaaagataatgctcatatcttctattttctggtgattatcttttggtagttatgatgacagaccaatagagatttaaacatttgaattaataggacaaaagataatatatgtttatcttttatccgtaacaaaatggttgaataagaaaaactaagcaaattaattgaccttgaaccatgcgagctctctttgcatttgaatgcttgctctttccaagtgtagagtgttgttactattaaatattctttttaaaatatttaactttgaaattgtagatgctcttttaatccccgtcgtatactgttaaatattcttttttgtcgaaataccacaaccaagtgcagcaggttccctccatttatggggtcctttattgccactaattcactattcatgtcaataagcatcttcacaacctcaacatttcctgattttattgcatgaaacagcactggcgaagcataatcaggtatctactccattagaatcgaattacatttcaattcgttaacttgagtcaataatttttcaaatagccgaccagcttctgattccttgtagtagtcctccatgactagcaagaggtgtatatatagttgattggtccaaccaatgtttaacatgaaatgaaacaaacaaaacttaaattaaaattttattcttatatatatgaagcaccatttttttatctctatttaaaaaattatatattttaatacgtacatgaaaaaaaaattgtaagatatttttgcacatgtgactcatgtgttggcaaacattaatttgtgttattagaataactcaacaaacatctaataccattattacattggatattgacaattaattaaggactagttcttaatttttttatataaaacaaaaatatatataactttctaaaataagaatcaaaatgaaaatgatgtcaaataagatctaaattttagcttagcacacacacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaccattttcaacttgtgagcttacctaaaatttctggaggcttttgcgtcagcatatgcaatgctgtaaggttctcttcatttcttgcaatggccagagtagttggatgtattttcaaataatcgcattgccaaatctgttatatgcacaaattaaatagtacaaggcaaggtaattaaaaatttaaaactccaactaaattgaaaaaccacgtacgagttcatatatatctccttttatatataaatgaaatcaatgagaatatagcaaggacctgtttggttttaaaggatgatatcacagtctttcagaaacctaatagtcataattaattatttcaacattttgaattatggtcaaatgtaccgaatgacgttggaattataattagcttatggtatttgatcggttcaatgggttcgattcagtttgtaaaacatcataatatataaaagagaactagattaaaaaatgagaaataaggttgtttaattagttttacacttaccaaacatgattgtcattaaaaaaatttacttcagtcaatagggaaactcgctagtggcttgtgaatgcaagtacgtctaaatgtctaatagtctgtgaggctaggccccacttcaacttactacacaaaggaccaacactgtggttttctgaaaacttttgctgaaaactatagaattggcattaaagaacctggcagctgtttaatattaaacattatctgaattatggaactttgtttttttttcttcatgatttgcacagccagagcctggacataacagtggaagaggaaggggtaggggcagaggtagaggttgtggccgaggaattagaactgtagatcaaaagatgagttcacatgccaagtgtgaagatgattctgatgtattgaagcagaatgacaaccacactcaaagcaatgaaagcatggaaaatgtgccggaacctgaaggagttaagcagagttttccagtaagcaaaccggctgaagtgtccattcgaaattttgacttaaatttggaccgagatgaggatatggattcattagacacaccaacttctgtgagagaagcatgaggaataccctggatggtccttgtctgaaatggaaaaaatgaccattgatcccattcaactagccaacacaaatggaaggattgatgaagatgaagaggattatgatgaaaaaatgtagatgaacctgtgttggtttattcattaattacttctcatataggcccgtcattagaatgttcttatgtggaattagagtagattttataggagcagtattagatagatacttactccttagtagtttaggaagattaggagggatagggcattgaatactctccttataacccttgttttaggttaatagtggagatatagattgttccaattagaaatagccatttgccagtatagttatgaattatgagaaattttaatctcatgtaggtattgcttatggtaggcactacattcagattttgggtgtgttattgctccaacaacatgatttgcatgcaaccttttgaattttagttatcgtgaacttattgcacgatgagacaagaggaaaagaataagacgttagacgaatagaaatatatacgaaataaagtgaaaaagatgtgttatttagatgaataaaaatagaaaggaaataagtgtagatatttattatttatgtttgtttaggccaaatgaaagagaaaatacaaacaaatgaattgtttgaaaaaaaaattatacatttttttaaaactatttccattatttttctaacataagattattattttttattatataatatacttatttgattttaaaatgtaagcaccactaatcgcttctctataaaactaatctcgcctcaaactagttggtttaaatttcaaacaattatttttaaataagcacttatttaataaataaataacgttgatcaaaataagtagaaaactgttttttaagcataaacacaatttagacaaatacattaaaaaactgaaaattatttattttattaaaataaatatttttttcaacaaataaatttaagcatacttatcaaataatatcacttgatttacaagcgggagtttggccaattagtacacgtcagacaattataaagaatgatttgaataattaacttattaatgtgggacttgtatgtgcctaccatgaggtgaacgttatctaaggtggaacataaagaatgttcttatggttttgaatctacttggaatactaataagaggtgaaactaaaattccaaagtacagttaacttggtcgtagctctagatccacattctcacatgcctccgtccctgattggagatatatgaagtttatatttaatatggataagtcctaggaaaaatagaatagccgggactcaatctcaaagtttggaataactataatttcttattaaaatgccgatctaaatggttcttaataacagtggttgtgagttgtgacatatacttgctcccttcaccaaccacagggaaagaaggggcaaagctttgacgtaggatatacagttttcggaaaaggcattatagtctcaaattaagtcggaaacactatgataggaaatgcacaatatcctaaattcaaagactaacttaattgtttcacaaacaaatatataacacagtgtggacactgccacactgtctataaatcaagatacagaaaatgacgagaaagttttagagtttgccagtatctataattatgtaataagttactagagttcggatggaagataaaatctagacaagtgtttgtcgaaaaagttaaattgaaagagaagaaacagaagtattgggaaaaccccattaaagccactgcataagaaacccacttggaagtgtgatcaaatatcagaaatgagactgcagtaaaagctgtagaatatcaaaaatttatgcagtgagaacttgtggagaaaacaacttctaacaaatattttattcaacttatttctctttctttctatcttttcttttctatctatttttctttctcttctctatcttttttttctctctcatattattaaatattataatgatttatttataagttataatatgcctttcaaaattttaaaagacttaaatcttattaataaacataacccacaatcaaaatctcattatagttatttataattataaactacaatcaaaattcattataatcattcatagttataaattataattattattaactcttgacctttcatttttgtaaaacaaaattgttaatgaaacccattaaacttttaagtttattcaacaaaagctacaaccatatccgcaacggagacaaaaagtatcgcaggctgcagtaaactcgctttctgcaaatcttgatgaagtgaaatttgacaagaatgagagtatagacgcagaagaagtcaataatgcgactgcatttgtcaatacgctcattggttgggatcaattaatatcaatgcataacttgattaatcttttaattacacttaataactattacaagttaattttttaagttatgatattaaaaataaaaaggaattgacctagcttgaaccatgcgagctctctttgcatttgaatggttgctctaaaactggacaatgctttgaattcaagtggcagatgagcagctaagtgtagaacgttgttaccctcattgtccactgctcctactatttgctctatctttttaagtatactaaaaaaatgtttatttttcgatatagggcagccaagcgcagtaggtttcgtcgattgttgggatcccttgtcatggtcactagtttactattatcgtaaagaatccaaccaagagcctcatcatttcgatatatagttgattggtccaacaaatatataacatgagcataaagaaataagttaaattaaagtttggtctaatatgaaacattatttttttgacacacacatcattaaataaataaataaaacaccattcgcaaccgatcatgaaagcttacttagaatttctgaaggctttcgccccagcatatgcaatgctgttaacttctctttttacctcttcatctgttgcaatggccaaatcaattggatatttttcaaataatttcattgccatatctgttacatgcacaaattaaatagcgatggtagattgcatatgtacaaggcaaggtaaaattgaaaaaccacgtacgagttcaactagataaaaaaaaggatgtttggttttacacttaccaaacatgttgctgctaatggtcataaaaaaagtcgttgaatatccttataaaccattttgtgaagaggacaaaatttgcaccattttgttgtggccatataaaacagccaagcaaactggaagcatcccatctgagtttggtattgttggataccaagtaatcatacaacaatcgagataggagaaggagagaaaagagaaagagaaaataacacaagtttatcctgattcattcaatatggactacatccaactattacctatatttccttacacactataaagcactcagattacaagaaaatatataggcttagaaatcttaaacatagtaactattcatgcacttaagcccaaattacaaataataaaacaaagctagtgtgagtcatacccaacaagtatcagcctagaatgatttgatatgcaattctactaataatgtgctcagtctcattaaatttcccttttttgctttctatttctcatatgcacaaacatgattacggctttataaccatacctaggattttttttaaataattagattaaaaaagttatttataattttttaaaaaaattatgatttaaaaaaacataaaaaagtataaaaaagtaaaaaaaaaattgaagaaataaaactaaaaaaatgtaaagaaagaaaaaatcataattttaaaattgtaaaaaaaaattatgacttgaagttataataaaaaaaaattaaaaaaagttacgaaaatcataaaaaaatttatgactttaaaatcgtatgttaaaaaaaattatactgaaatcgtaaatttatttacgacttcagtgaaaaaaattaaaataaatataaattataagtttgtaacctttgttacgacttacggcatatatctttatgcaaaaaatttaaaatctacccaaatgataataacaataaaaaaaattaccctctaaaacccatgattagacgtgtaaatgatatctacggaagaaaattaaatgttgggatggtcttggttttggaacatgtgttgttgttctagtgtttaccttcactttctagtttctaaaatgtctgacttacttgcatccttgcctttgcagaaaacagtgagtgcagacttttaatgtctttgattttctaaaagatattgtcagaagggtttctgatttaggtggttctgttgcaactggtgatgatcatactgtcactaagaggtttgtgctctgattaatactcatgttactaggaacatgttttttgtgtggtgaattttgtttatttattttatattaggaaagatgatgataatgacagccacgaggatcccaagagaaataactaggtaatatatcaattcagactgagttggcttaaaatttttcttttgtgactaaaccttctgctgagtaattatctcttgtcaatgcagactgtgaaccttttgctggttacaaaagaatttacttcagtcattagggaaattcacaagttgcttcactgacttgcgaatacaagtacatttaatagtctgtaaaccttactatacaaagaaccaaaactatctggttttcttaaaacttttggtgaaaactgttgttgtaattgagcaaactattcactatagaatcagaactaacacataatgtggaaattctagctgagagatgcaacattctaaagaacctcgcaaaagcttgatgttaaatattatctgaataatgattttttttcttcatgatttgcacagagcctggcattgcagtgtcagaggaagggggtatcaatgtcagaagagaagcatgaggaataccctgaatggtcattgtctgatatggaaaaaatgaacattgatcccatgcaactagctaattaacttaaatggaaggattgatgaagatgaagaggattatgatgaagaaatgtagatgaacctattttggtttagaaagttctaattgagaattagagtagaatttttaggagtagtattagacaaatccttagtggttaggaagattaggagggataggacattggaaactttagtccttacaacctttgttttaggataaaagtggagatatagattgttcgaattagaaatagccacggtattgttatttgagaaattttaatctcatataggtcttgcctatggtaggcactacattcagatccttaaacttacggattttgattttgtttgggttgttagctttgattgtggcgttgtgtatgcaagtcagttattgtatcgcacgacgtttcctctcgagtacaatttgagagcaaatcgcagagcaaactcatacgacatgatttgcacttgaaccttctttgttatcttgaatttgatgagaaatcagataaatggaaaagaaataagagagataaaaataaaagtttaatggctatgtactaacactaacaatataaaacaattttaggattttacaaattatcattcaattataaattatcattttaaaaattaacaaatttattatatatacgatgagttgtactttgatgactatataaatttttttacattctcaatacataacatttatctaaaaataaatacaaaataagatgaaaaagatgtattatttagatgaataaaaataaaaagaaaaaatatataaatttttatttgtttgaataattagagagtataaaacaaaaatatggttattgcaaaaatgttcatacaaataaaaaataaaatttaatttgaaaacctgaactttttaattatttcgttatttctcaacataaaaatattttgttataaaacaataatttgatttttaaaaatttaaacatttaaacataagtaaaagaacactgctaaccatttctccttccattttacgtcacttggtgagaaatattgtttggttgagactcattaattataatttcatttctcattttctaacacattcaatcaagaatattttttattactttatttctcttcattttaattttatatttattataattttgttgtatatagtaattcttgtcaagattgagtaagattaagtctaagtgaaagatgaatgtgtaataaactgtgttatgatttgctcccttcaccaaccacatggaaggaaagggaaaagctacgaagtgggttatgcagtatagtctcaaattaaggggggaacaataagaaaggtaattaatatttcatgagatagaaaatgtagaataatctcaaatttaaacacaagcttgatggttccacaaacaaataataatacagtgtcttaaagttatgccaatgtctgcaactctgtaataagttagtccagtttggacaaacgataaaatctagaccacaagtgttcgttgaaaaagctaaattgaaagagaagaaacagaagtattgggaaaagccccattgaagccactacataagaaacccacttggaagtgtgatcaaatatcaaaaaggaggctgcaatgaaagccacaaccaaagcagcaacggcgataataagtaacgcacgcccagaagtcaagctgggatgtagtgatttcacaaattcactttctgcgaatcttgatgaagtgaaatttgacaagaatgagagtaaagacgcaaaagaagtgaataatgcgactgcatttgtcaatatgaagacagtaaaccacgcattggtcttatcacctggaacagtcagagcagctgcaaatgctacggtagcaacaagtgttgacacaagcatgccagattcggccattcctttggctgtttccttaatttcttcagataacttcttgtgttccttataaaatacattcattggtctcatgcccgctttgtttctcattattcttagttcatcaggaacattccgctccactaactatttacaaatcaagagtagatgtaaatgatggtatccaaatgcataacttaattaatcttttaattatcacttaataactagagcaaattacaacaacacctcctaatatttagagtaattacacaaatattttttgagatattagagtaagttttaaggggatgttagtgtaatattttcaaacatataagagatgttagtgtaattttttaaatttaaaagaaattagtgtagaaaaataaaaaaatggaattacatataattatatgaaatctctggaaaattattgtaatttcctcaaatagctattacatattaaatttgtaagaaatacaatttcaaagttaagatatttaaaaaataaatcttaggggtgatatttatttttacaaatgcacttgtattatttttaattaaatttttctgttatatattggctgtttaactattatgctaaagacaatggataacaaattttaaaaaattattacaataatcaacaaatactacatactatgatttctatttttatttaaaacttgttacttttgaagatttaaaatcagtctagttaacataagcccaaaattagtggaattttaaatttttaaaataagattgctagaactgatcgatcccatgcgagtgaataaagaatggttgaataaagaaaactaagcaaattaattgaccttgaaccattcgagttccctttgcatttgaatgcttgctcttaaactggagaattcttcgaattcaccttgtggaagacgcgcaaccaagtgtagaatgttgttaccatcattgtccactgctcgtactagaagcccttttaatcccggtggtataatattaaataattctttttgtcgaaatagcacaaccaagtgcagtaggttccatccatttctgcggtccctataagtcagtaatctaggatcattgccaagaagcatctccacagcctcaacatctcctgattttattgcatattcacgactctgttccaatgtttcaactttagtcaatatttctccaaatagccgatcacaaacgactgattccttggcaaacattaatttgtgttattagaataactcaacaaacatcaaataccattattagactggatatagataattaaggactaattcttacttttttatataaaacaaaaatatatataactttctaaaatcaaaattaaaatggaaatgacgtcaaataagatctaaattttagcttagaacgcacaaaaaataaaaagccattttcaacttgtgaaaggttacctgacattcctctaggcttttcccccagcatcttcactgctgtaacgtcctctacttcatttcttgcaatggccacagttggatgttttttaaacaatgtcattgccgcacctgttatatgcacaaattaaatagtacaaggcaaggtaaataaaaacaccaactaaattgaaaaaccaagtacgagttcatatatatctccttttatatataggaaatcaatgagaatttagctaggagctgtttggttttaaaggatgatatcacagtgtttcagaaacctaatagtcataattaattatttcaactgattcaatgggttcgattcagtttgtaaaacttcataataggtaaaagagaacgtactagattacaaaaaggagaaataaggttgtttaattagttttacacttaccaaacatgtcgaacctaatggtcatcataaacagtcgttcaatatccttgaaattcattttgtcaagcacttcatcagaggacaaaatgtccaccattctgtcggaacgaattgcagcagccaagtgaactggaagcatcccatctgagtttggtattatcatgtcttcgggcctcatacggttaaccaacactttcacaatttcagagatgtatttacgtgctgctacatgaagagctgtgtctccatctgagtttggtattagcatgtcttctggcctcatacggttaaccaactctttcacaatttcaagcctgcattcccttgctgctagatgaagaactgtgtctccatctgagttttgtattagcatgtcttctggcctcatacgcttaaccaactctttcacaatttcaagactgccttcccttgctgctagatgaagagctgtgtatccccttgagtttggtattagcatgtcttctggccttatacgcttaaacaactctttcacaatttcaagactgtctcctcttgctgctacatgaagagctgtgtctccacttgagtttggtattagcatgtcttctggcctcatacgcttaaccaactctttcacaatttcacccctgcctttgcttactgctagatgaagagctgtgtttccacttgagtttggtattagcatgtcttctggcctcatactcttaaccaactctttcacaatttcaagcctgccttcccttgctgctagatgaagagctgtgtctcctctatcatttaacggcatgcgtaccatatcaggacattcatcaataatcgattttaattggaaccactgatccccaaatacatgtcttatcaaatcgttttttaaagaacctgcaatcctttcaaacttcacattataacatgtcctttatttaataatcacaacttttagtatttagttccaaagaagacccttttaatttctcgtttaccctaaatctgtaaaacttctcttgtctcaaattttgaattcctaataatttcatcatttgtaaattgaaatctagctgagaaattcgagattatgtagtccaaggaatccaatcatcaatcacgtttgaaaattgaatttgaatttttgtttgaaaatcaattctatgataagaagtaaaattgtttttgagagaagtaatttatttttttcttttcttcagtttacaaaagctaattgatcttaacatgtgacttatttatactcactttaaaagtgattctacttttttatcattcgaataaaaaaaataattttataaacccattattgaaatatcattcgtataataatagtataactatatttttcttaacgtcaagtggtttcaaatttaatttttttcaaatatgtaaaataaacaaactcttcagacattatctctgaaatgttgtgaatgcaatagtttcaagtataacttactcagcccttctcgagtcatttcactcattcctatactgccatgttttggtgccggtgagtttgttgaagtggcaattggagtttgctcatgattaggagtatgatctgaaacttcgatatcggagttcatgatttaattctagggaaaatgaagtgaattggatatttgtggattacagcaatgtcaatacaatctgttcaacatgtcaaccctagagttttcaaagtgaataaatatattcattaaatttgttaacataaaaaaatattcattataaaaaaattatattcattaaattgtgtggattagcgagactatcatgacactctgttaattaacttactctcaatttaatattatctttcttagctgtacaatgatatgatatctatacacacctaaagccttcaagttcctactcttatattgttgacgaaaactttctgccatagcggtggttatatatttatctaacttcagttgacgcatttaattctatgattatatgctaactctggtctttctatactagttataatcaactactccaacaaccattgaaacattcaaagctaagactagatgcattttattatcggaatatgtataaatttattaaactcactgataagtgatatcgtatcgtttcaaaacaattaaactacactaattctataacatattattaacctaggtcgactaagagacactatcaatatggtttcaacttcaattcactaataaacaataggagatttttgtcaaacagtttacatgcgataagtaaaaattacaaaaaacgtataaactaatgcgaattgataagaggtaatgtaaaacagattaaatagcatcaattcatacagttttcaagagctttttaagtgaatggtttctaaatttataatattaattcttttttaaattcaataaatatattcattaaatttgttaacggaaaaaatatattcattaaattgtgtggattagcgagactgaggtatcatgacactgttaattaacttactctcaatttaatattatctttctttgttggacaatgatatgatatctttacacacctaaaaagtaaactacacaaactatccctaaagttttgtgaaattatataaactttcttatattttttaaacatttacaacaatctcgcttatagtagttatcggggcagaaaaaacatgaaaagtttttataatttcatgaagccctaaaaatggttaaggcaatttagtcttttttaaatgtattgtgcaatttataaaaatgattcggttaattgaacaaacttttgtacaactgtgcaattcatctttttttaaaccagttcagattaattgaattgattttttttaaagacccctatttacggatgtattgtgctttcagaacacctatttagtaaccaaaatatgaattcatattacggaagtagatgcaaaaataattacaaaacatttaggagcatatagtacattatgggacatttagataaatataaatgtatttcaaaattcaagtattttgtaatgatatcttaaatgtgctgtagaagagatattccagctcatcttatggacagatgttgtttcagaacacctattccataaccaaaatatcatactttcaaaatgcatatattatgtaatatattaaaaaaaataacagaaaaggtatttcaaacacgtgacgaatatgtattgttattctgaaatacttattaacctaaatatcatatttcccagaatgcgtattccacaatacattaaaaaaataattacagaacatgtaatctagaacaaataatgagaagtattttgggagtcactcgtagattttaaatgagaaaggaggtgtaacgtaagttaatttttatattggatgcaggaagaaaacgcctaatgggaaatgtgagctcggtccatatgagaaaagagacaactctgttaataaagaatgaaaaaaaaagaaaaggaaacacacaaaagaaactagagtggaccagctcaaacatgtaataatgtaatgtaatgtaacaggagacaggttcacagagaggaaaggattatgaaaggaaactagcatgcatcacagttatatatatacaaattaaaggttgaaggaaagaaatcatacccaaatgtctttttactgaagaacgatggagaaagaaatgcccgtgggatgggtgaggaggacccttgtcttgttgttgctatacgttgctcagtgtctgagtgatgtgggagcggtttctgagcaatgttatatgcaaagagagtgaagctttatgagacttaagggtacggtgtgtgcgtgcctgcagatgaggctgtggactatttataatttattaggtggtccggaacaaatacaatcaatatcttcactgatttttatatgacatatagtgttattatttttttcataaattataaaatttgaatgcatgttatgtagacatcggttgagattatgaatacaaagtgattccacatacactctttaattaatttctcgtggctggcatgtgccatgacaaaaaaaataaaaattgttgagcccacatgcaaataacgtgtcctgattttttgagtggggaaaaagcaactgcattagacatgggaaaacattcttcttctttacccaaaattgttaccttacttttttgtttttgttgtcatcttttgtgtattttaatatttcctataccttttgcatttatttaattttttacttatttttatccatttttttaggcgtatatttgaaatgatactttagattagttgtaaagctaagcaaattgccttgttagattcttcggaatgtcattcttttcaccttccgagaagccagaaggggtcctttcttcctttgttaaaactactgcttccaagtattccataccaacaaaattcttttcccactaggtgggggtggaatatatggataaaaattaaaaagccacaatgtcttattataattcatgccataacactaatcattcaaatataattaatatagtttttcttggtctctccctatctctaactaatgcgactaccctccatttgatcctgatgtacttcctttattcggattctatagcttttctccacacatatgtgaaaaataggcactaattaaggtcttctgtggcccaccttgtgttgttacattagccttgaccccattgtacatgtccacctagcttgaactagggttggtaaaaatggtttgacctaatgggtcagttcatttggcccatgaaaaaatacggactgcactgaacccgacccacaaaaatgtaagtcaaaatcggacccgaactgggtcaatccaccaggccaacataaattttaaaaaaaaaacgaagagtccagtccaatagccacttagccaggcccagacactcaaatgcacaaacatcttatatcttcttcgtgagcgtgagtcgagacccactgtccactaaatgagacagagactcgtcaacgtcgacgtcgccgtcaccctgagcagctccgtgaccatgagcgatgagtctgtggccgtgagggaccgagggtgagtccgtcaccgtgatgactgagtgaggaggcaccttgagttcgttgttcgctgttggcactgttgcagaaagagagagatcccgctcccgctgtgctgcacccgcatcgcctgtttgtcgtccgccagaaccatcagaactttagaaggagcttaagcaccactggattgccaccaaccaccaccactaggtacggaggcaccgacagatctatatgggttgcagggtgggcagatgcaccccctaatttcaataaaatcactagtatttgtcctaaaatattatattttgcatcccataattttacattttgcaccctctaattttatgtatttgaatctctttaccagttcacatgtaagagtaaataaatacaccatcttattttaataaaatgcaaaaaaatattatattttgcatcccataattttatattttgaacccctaattttatgtatttgaatctccttaccagttcacatgtaagagtaagtaaatgctaggggtgttcacgggtacgggtcacccgtgaacccgaaccgatctgaacaatttgggttgggtcatttatatatttgggtcaaaatcgaaccgaaccgatcaaaaccgttcatgtacgggttgggtcacgggtttagatttacagattcgttgatccgatgacccaacctgtgaacccgtaataataatataaattttattatatatatatatatatatatatatatatatattaaaaattaaaaaaataatttgacaataaaaaaagatatgatattttaaatgtttaagattgcattcaaaaataagataggatattttttaatattgcattaaagaaaatgatagaatatttttaagattgcattgcataatataataaaatatctttaagattgcattggataatatgatagaatatatttaggattgtattcaaaaattggttaaaatcatatttttaaattagtatagatttaaatgaatcaattttactacttttatacatttgataatattgtgttaattgtatgagatatttgaaagaatcgtgatataaaatagtagttctaaaaaaaaaattaaatgggtaatccagtgatccgaaccgaaccgaactgttcatgaacgggttgggttgggttttaatttttttttgaaaaccgaaccgaaccgatgaaatttgactgggttgggtcctaaatttggtcaaaaccgatctgaaccgacccgcgaacacccctagtaaatgcactatcttattttaataaaatgcaaatatttatcttaaaactttatattttgtacatcttatcttcgtatttgaatccaactatcccatatgataatgatatcaatttttttaaataaattacccctactgatatattttgtacatcttatcttcgtatttaaatccaactatttcatataatgataattatcaatttttattttttaaataaattgaccccactgatccagggtcctagatccgccactttacggatgtatctttcgtttgttactctactcctttttattgctttttattttattcctttgtaatcgtttctgcaattttggtctgctacacgcctacacggttcggtccatgcatgcatttttttccctttggtgtccctttcgcacacttatcatcattcacttggatcacttcacatcctatgtacagttcctatttattttgatgaacaaaatctgtttgctatctgatgttatttttcaaatgtttcttctaaccctttggttttgcagctgccttttgatgaaagttttttgtttcttctgtattcaaaggatgatgtaagtttgagaaaatggaaggatcaacttcagggaagtgttgacatatctgttgttggaagtggtacttgtttttctcttcaactccttctgtggtctttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtaaactcttgtatatatacaagttctataatgattatttaacagagataaagtgacatttaacttgatggaatgatgggaacattacctctttattgcaagctattgttgaagatgatcctcttcttatctttatttcacttaaccaattctaaacacaactgagatggtttgcttttaaaaaaaacaaaacaagataaatcattttctttgaaacactaagtgaaatagacttaaattagcatagtcttccggttttcttaggttggctccaacctccagctttttttttttacatttatggtaaatgtcaaattgttttgaaaatgaaattcaccttcactgtctccaacaacatcgtttctggtctcaaatgacaaatacacaaatgttgtttggaaaattggcattagaggtgagaatactctgtctcgtctttactttgattaatttaatctttttctgggtggaatttactttaattgattaaataatgttcattgtaattcttttttcttgtttcagtggacagcagaaaaaagatgtcgggaacttttagtcccaagcaggaaccatatacatttgaattggaagaagaaaatgcttctgtaagttctgtttgtagattacgatcgaaaatgctacttggatgttacttactatcaaatcagaagaacagaccaacacctcaatgagatttaaactggagtaacttgttggaaaaaatttcttccttttgcattttgtgtctctttggaacagattgaaactcaacatgtttgtcaattagcatgattatattttttaattaaatttgtattttttatagttttttgttttttttaaattaacttttttattttttagatggattgaccaatccacctaaaaataggacgggttaacatttttagcttattttgcaaaaatagaccagtccaacccaacccatatttttggtgggttaaaatcaatccgatccattttttggtggaacttatccactttgccaatcctagcttgaaccatgggagctctctttgcatttgaatgattgctctaaaactggacaatgctttgacttcaagtggtagatgaagagctaagtgtagaacgttgttaccttcatgtccactgctcctatactatatgtcctatcttttattttcagtatactaaaaaaatgcttatttttttatatagggcagccaagtacagtaggttccgtccattgttgggtcccttatcatggtcactagtttactattatcgtcaagaatccaactaagagcctcaccatttcctgattttagtgcaacaatattaatattgcagaaaaatatcgtaaaacaagagcacaatcatcaacaaattgagtataacaagataacaacatatatttagacaaatttattatgcaacatcatctcattattaatattttttttagacaaatttatatgaagtatttttttatttaaatttttaagtcttttgtttatttatttttcttattgacaaaacaaataaaatccacaaaataaataataatctttaacattaataacaaaaatataaaaatattaaataaaataatatacaaaaatgtaaattaaaactactttagagttgaaaactaatttaaaaattaaaaaaataaaatgactttaagtcgttaaattttttataaatttatataaataattaaatataaaaaaaattaaaatgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatattctaattttgaatgaataaatatatacattaaaaatattattgatccaatcctaaatataagactcttttataactaattcacatttttaaaaaattaattaatttagttataaacattatatttattaataatttgtattattttcaaaaaattaccattaaaacttttagatatcatcattttaatctttttacttaattattttctacttaattaatatgtgctagctagttatctgaatatctagtcctcgtaattaagagagaaaatcaatttactatgttattagtttataatatttattataaattaaagtatttaagatattttggtaaaaaaaattaatgcaagagataaattaaaaaaattaacaaattcaaaaaagaattttatatttagaaatgagggtagtgaaaacattacaaatttatttttattttccaaaagattttttttttctatttacttggttgaataaaaaatataaaatgtaactcaaaaaacaatcttgatatcttttagaatataatgcaatgtagcggtacacaaggagagtgctgctgcttcgtcataaaatgaagagagcaaaggaagaagagaaagaaatggaatgaacaacaaaatggacatgcatgcaaagttagcactcacattatttattccgtgggaacgagtggaatcgatcggcaaatgtttccctccatgctccactcttttggcttaggtttgctttgtccaattcattgtttccttgtgtcaaaatcacaattgtatttcataatgtgtgctttgaatattattcggttaaaagtatagatagaaggtagcacaaatcaggtggcacctcttatatgtttgtaattgtattgattacaattaattagtaaaagatacaaattataagatgaaaacatcctgagttttaaaatcaatactatctggattaattagcactactacaagaaaggcttttaaggtcggttatttgacccattcaaagtcggttctggaaccgaccttgtatggcaacgtcgtcaaaaaggctagcctacgacgtcggttctttgaggaccgactttgaaattttttttttttaattttttttttaaaaaaaattcgtacaatctaagtcggttatttaaaaaaaccgactttaaatgttagatacaaagtcagttattttaaaaaaccgactttgtattcgacatttaaagtcggttttttaaaataaccgacttagattgtataaattcaaataaaaaaaaataaaaaaacaaacatgtacatgcaggtatacaaagtcagttattttaaaaaaccgactttgtattcgacatttaaagtcggttttttaaaataaccgacttagattgtataaatttaaataaaaataaataaaaaaacaaacatgtacatgcgggtatacaaagtcagttattttaaaaaaccgactttgtattcgacatttaaagtcggttttttaaaataaccgacttagattgtataaattttaaataaaaataaataaaaaaacaaacatgtacatgcgggtatacaaagtcagttattttaaaaaaccgactttgtattcgacatttaaagtcggttttttaaaataaccgacttagattgtataaattttaaataaaaaaaaattaaaaaacaaacagtggtcagaagcatgattccattttattttaaataataatcacctaaatgtcatgatcttacttcatgcttattaacaaacaattcaaaacattcagtcaggcctggttttgatctgtgcccctttcataaaggactcatgatctcagggtggtttatgctgaatgtaggatttacacacgtctcttccaaaaagtgaccaacaagctacaatatgaaaagaatataattatagttccagcaggcacatcataagaagctcaaaacaagaaataaaattacattaacaaagtgcattaattagaattgtgcaaaattgaaactgaaattatgttctatatttaagttacaagtagaggtaaaatataaaacaggaaaaaataacagtagaccagaatagtacccaagcttcactacacctggagccacattatagaaattaatgttacaactcactaaatacaaatgttgggtaactggaaattacagtcatattactacaatgcctagctgttgttttacaaagtctagaatgtctgcagactacagttttatccgctcccaaccttcatatatatatatatatatatatatatttcattttcccacccataacacacaaaactaatgcttttatgtccaacaaacgaactcttatcctggtcttaaatcataccatgtacaacaaaaaaaggtgagagaaaataccactgaaaaacaaggccattatattttaaatacattctgacaaggaaaaggaacgtaaataatcttttagataaaagcaatatttaaaaacaaagtatataataattaaagaaaggagattactttatccaacaaacgagcaattgtctcagggggaggacatttgatctcatacttcaagcacgtgtccttcaaatattgattagcttcctcactcgacaagtctttgggaaaacttaggcctgccaccttctctgcaaatatttttatagttgcaaatatttaacattagtgtaaagcatttctgtgctgcttgaaccatggacacacaccgaaagaattcatatctctggtatgtgcctacatgcaataatttatcttataaagctcattcaccttacttcaaaaattaatttaatttaacttgcaagaaaagttggatacgttttaccttctcattcttttcctaataatttgccacttaacataataaccatagtcaaaaggtaaaacaaggaataagcttgactgagatttaccaaaatgaaattccataacatcaaaacactaaaatatcaaaccaaattcatccaacttggttggtcattgatattaaaaaacacagtaaattactccttagaacaaaactttgacaaactcatgctctagtgttaattaagaatatgttctggacaaaaaagctgaatagactacaccaattaatcgaagagactgaaacccatatcctgcatcacaaaacaaaatgaaggataaacaatcagaaaaacttcagattacccaaataaatttacgagcgtgaaatttgcaccaacagaaagctagttattacacaaagctacttcgtattgaaaggcaagatgttctttgatctatatgtccaaccaacaagaaattcagaaccattttaattacagaatatgcaactcaattagtatagactcaccaaacaacaagtttaaaaccattcatagtgtttttggatcagcgttcgtaaaattgattttgaagttatgtttggatgatttttaccttgaaagcaagtttaatgcaaaacttggcttaaatttttaaagtcaacgcaaaagctatgttttcacctgtagtctaatcgagaattggggcaaaatcaattttacctaatactaaccaagcatctatatttctactaaaattacattgaactggaagtaaaatcaattctgatgctgtccacagtcaaaccaaacacacacacacacaattagaaatgcaacaaattaactaaagcggcaggggtggaaagaaacacttacatcatcagattcctctttctcctccaccttttcctctttttttgcctcagcaactggagcagcagcagcaccacctcccccaggagctgcggcgacggcaacggcaccaccagaaggaaccgaggccaacttttccttaccggcagcaataagctcaactatatccttacccttaacttcagacaaaaacgattcaatcctatcttcatctgcctctactccaactgcaaatcaaaaacaaaattattacccatttctcaacctgatatctatgcaaatatgcaacaacaaaattattacccatttctcaacatgagggagacatcttgcttcatcattcacggcggcagcaccgcgcacgacgacggtgcagacgagatctgcactggaaagaacagtgtgagatggagaaggcataccgcaaccacggtggatggaggggagaccactgcgcacaatgacgatgcatacgagatctggcacaaagtcgaggtttttatgggtgtggtcggagtggaggtgggtgagggtttggaggaagtgaggctgagagagaggttttcgactttggactcagggaaagcaaaggaaacgaatttaggttacagcnnnnnnnnnnacacacacacacaattagaaatgcaacaaattaactaaagcggcaggggtggaaagaaacacttacatcatcagattcctctttctcctccaccttttcctctttttttgcctcagcaactggagcagcagcagcaccacctcccccaggagctgcggcgacggcaacggcaccaccagaaggaaccgaggccaacttttccttaccggcagcaataagctcaactatatccttacccttaacttcagacaaaaacgattcaatcctatcttcatctgcctctactccaactgcaaatcaaaaacaaaattattacccatttctcaacctgatatctatgcaaatatgcaacaacaaaattattacccatttctcaacatgagggagacatcttgcttcatcattcacggcggcagcaccgcgcacgacgacggtgcagacgagatctgcactggaaagaacagtgtgagatggagaaggcataccgcaaccacggtggatggaggggagaccactgcgcacaatgacgatgcatacgagatctggcacaaagtcgaggtttttatgggtgtggtcggagtggaggtgggtgagggtttggaggaagtgaggctgagagagaggttttcgactttggacacagggaaagcaaaggaaacgaatttaggttacagcgggtcgcggccggtcatagaaagaagggaaaaaatttaaaatagttttttaataatttaaaaagcatcaaagtcggttcttataaaaaccgactttgaataatagtaaacaacgacgggtcataataggaccgacttcgtttttgtagtattgttaaagtatttacaaaaatgccaccggttcatttacgaagtcggttatttaacaaccgacgtggattgtgcgtcgtggtttaaacattttgtagtagtgtagtgtcgcttcaaatcaaacttctgaatgtcatattactatccaagatctaattacctgttttttctaattgtatgtgcttgtttgctcttccattttctccgtatagactacgaatgttacagtagaacatgagtagcaatatagagaaaaataaatgcaaactaactaaatgattggataaaacaaaacaagagatatcaaatttaaggtgttgtgattgtttgaggaagatattcgcacacgagatcgcaaccagtattagaaaaaccatcttcaaattggacgattcaactactggatcgatttgcatgtttgaatgtctgatcagtaggctactggatcgatttgcaattggtcaatagactatcttttagtttctttctattcaaactctttttagcttagcaaaacttgaaactaattcttttaaactaattttggtttagtttggttcacaggaacatttggtgcaatctctctgagttcagttcgattcaaagctcaaagcccaagtataaaagtaaattgtatgcacttgtgtaaattttccatgcctttctttaatttgctgacataaggggattagagcttatcattagcaaaaatgggttcaccacaagaaatatgatatatgcttatagagatttttgcctatagacataaattattgtaggtaaaagtcaaaaaaattatatctatgaatacttttgcctatagacatattttatggtaagtaaagctaaaacatatttttatctataaatatttagggtaagtaaaatcttgtattaatataataaatatataaaattaaaaaatacctctacttacaaacacttaatgtaggtaaaatttcaaaaatcttgtgcctacaattgttcgatgtaggtaaaattctaaaatgtttcggcctaaaaacatttagtttaagtgaaattttaaacaactgcatgatgtagctaaaactcattaagatttctacctacaaatatttagcttaggtaaaaactttattttaaatttactataaatttaaaatatattttatacatttaaaaatatctatttagtatgaattataattatataaaaaagtatttttagaaaatttatttcaaaaagataaaaagatagaaaaataataacatcataatgtatttcaaaaaataataaaaaatttaaatgaatgtattaatgataaaaagtgaaaaaaatataaaaattagaaattaaaaactaaaaattacttgaaacaacaatttaacaagaacttacttagaaattatttattaaaaagtcaaataaattagtaaaaaaataaaaatttgttaaaatgtcttgtaaaaaacaatatatatcaactaataaattcctttaaaaactatactcctcaaaacccttcttcattgctgcaacttcacgcgccagatctgcaaccattaagttatgctccagcaccactacgcatcgcttattctcagcaccaacggacaggcgccggcggcgaagccgccaccgcagaggacggcaaggcacgagaaagtttatgtcacggcactcgcatatgaagtatgaactcaaagattcacctggtttaggtattgaatttttggagtttcgattctgaataattgaatggtccattgatttgattcaattatggttggaattgaaaatatgatttcaattttcacgtgtgttacttgactgtgtagttcctattggcatgtacggaattcagcactactttttcatattaggttcgttggttctgatttcgcttgtgattgtttctgccatgggaggcactcatgtgtgttgttttcgtgtggcttagttgttgtttttcgtgttgtgttgtgattgaaaatttggaacaaagacagctgataatatattttttttatcaaattgaagaaattcaagcatttaatgagggagctccagggggctatagttattggctcagctttccaaactttacttgggtatactggacttacttggctatagttattgtttgcacctttcaatttagattcctaagcaaatcacaccttaaaagtttaaaattatataatcagcttacgaaacttttgaaaaattcgttaaaatttcatagacttaatacgcgacttgcattcataccaaaagtcaagtggtagaaacatattccttgaaatccgttttgggtttcaaccagagccagattacccttcttggtgttgccaatgatattggtgagaatgttggcattcttccacgactagcctctgcaacaagttattattcgagaaaacaaaggcattatgcaggaccaggacttgttattcgagaataattgtagtatgagtatcaaacattttttatttattattattattattattattattattattattattattattattattattattattattattattattattattcctttattcatatttgttttcattgtattatttgattcatttagtaatggctattaatagtattgtttgttaagctgtacatggagttgaaagggcctagttaattatcacctctttctatctatggtgttgcagctagctatggtttgattttccacacttaaccaaaattgatatgatatgttaattttaaccgagcaaaataaaaagtctgtgcccctatcttacgtttccgaacttacataaatttggaatccaaattataatttgttgtttccataataattccaaaagtttggtaaatgatatgatatgagcaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatttttaacacaaaaattaaagttaacttcattttatcattttctctaagtagccaataaaaataagttaatcactttcttatccgacctcacttggtatgttgcaggaagtctgaaaaatcacttttatttaaaatgtgtccaatatctttaaatttatttatttagttaaattatttaccttagtaaatgtttcaagttctcaattacttgaataaagacgtgtgaattattcctctatactcactccagggacttcaccttctgggcaatttgcccgtgcttgctgtttgaattgccaatatggtaagcaaaggaattgcagtgtacaatcacaagggccataagatgtggcaacgtccagaaaataacactattgcctcagtatcatgttgcctgctcagaatctggctaagccttataaaagcttcagagtccgtcaatctcacaagtttttatgattggcagccagatggcaatactatgacaaaactccaagacctgaagcattctttcggaacggaatcacagctctactttgatgaaccgggacacatgtacataaaaattgatttttatcgtccgaggaattgaagtttagctaaataagagaaattgaatcacataattaagacgagcaagagattatcttagggtggaatcaagggaatttcaacacctaaccatttttattaattgatttttctagtacattattcaattgtgctcttgtttctttcaattaaatataataaaaagtccaaaattcctaattgtttatctcttaaatcaaaagagtaatcgttaatttgattgatgtattgttgataaaccaatttttttattgatacaataatttctccttattttatcaattgtacaactagtacttgtcgtaattctcaacaaactacaacaatatgctggtagaaggtgactcagttgatctttaagtcactttacgtgaagtccacatttcccacagtaggattagtgttagaaaacgttacagttcagagtaaagctttcaatttaatttccatagaactaaacgtgatggaaataaagttagtagaaccgtagaaatatagatgacagaatttgtttgatgttaattaatgtaaatgtactttctattgatattcaataaatttgcatgttgtcatcgttaaaaaataaaaagataaactattttctaaatttatctttttagtttttgaatttttatttattttttaatcacttaattttttagtatgtattacatttttgtttgcttggaactataataacatatccgtagagagagtctcacaattgatttttaaggcagcatgacacttcacgacaggttcattccattgctcaaagttggattagtgctaaagttaagagggaaagccttaggcttctactgaactgaacgccaagaaaaaataataaaatgaaaaggatgtattatttagatgaatagaaataaaaaggaaaaaaatgtaaatttttatggtcattgcaaaaatgttcatcaaataaaaaatcaaatttaatttgaaaaacctgaactttttatttaattatttctcaacataaaaatatatgttttgttataaaacaataatttgattttttaaaatttaaacataagtaaaagaacactgctaatcatttctccctccatttcacgtgtgttagtgagaaatatgatttggttaggactcattaattacaatttcatttctcattttctatcacattcaatcaagactatttttttatcacttttttctcttcattttaattttatatttattataattttgttgtatatagtaattcttttcaaatcgagtgggattaagtctcagtgaaagatgaatgcgtaataaaaaaagcttttttttgtgtcatgatttgctccctgcaccaaccacatggaaggaaggggaaaagctttgaggtgggttatgcagtatagtctcaaattaaggcgggaacaataagaaaggtaatatttcatgagatagaaaatgtagaataatctcaaatttaaacacaagcttcattgttccacaaacaaataataatacagtgccttaaagttatgccaatgtctgtaattctgtaatgagttagtcctgtttggacaaacgataaaatctagaccacaagtgtttgtcgaaaaagttaaattgaaagagaagaaacagaagtattgggaaaacccccattgaagccactgcataagaaacccacttggaagtgtgatcaaatatcaaaaagaaggctgcagtgaaatccacaaccatagcagcaacagagataataagtaaccaacgcccaaaagtcaagctgggatgtagtgatatcacaaattcgctttgtgcgaatcttgatgaagtgaaatttgacaaaaatgtgagtaaagacgcagaagaagtgaataatgcgactgcatttgtcaatatgaagacagtaaaccaggcattggtcttatcacctggaacagtcagagcagccgcaaatgctacggtagcaacaagtgttgacacaagcatgcctgattcggctattcctttggctgcatccttaatttcttcggataacttcttgtgttcatcacaaaatacatcaattggtgtcttgctcatgttgtttctcattgttcttagttcatcaggagcataaatctccacgaactatttacaaatcaagagtatatgtcaatgatggtatccaaatgcataacttaattaatcttttaattatcacctaataactagagcaaattacaacgccactttatgaagtttagtaaggtttgagggaatgttaatgtaatgttttcaatatgagatgttagtgtaatttttcaaatttaaaagaagttagtgtaaacttaaaagacgttagtgtaggaaaataaaaaaataaaattatatacaattacacgaaacctcaatgaattattgtaatttgctttaataactattacatattaaattttaagaaatacaatttcaaagttaagatatatattttaaaaataaatcttgcgggtgatatttgttgttacaaatgcacttctataatttttaattaaaattttctttcgatctatatattgcctgtttaactattatgcatgctaaagacaatggataacaaattttaaaaaattgtcacaataatcaacaaatactacatacaatgatttctatttttaattaaaacttgttacttttaaggatttaaaatcagtctagttaacaaaagcctaaaatgtgtggaatttttaaatttttaaaaaaagattgctagaactgatggatcccatgcgagtgaataaagaatggttgaataagaaaaactaagcaaattaattgaccttgaaccatgcgagatctctttgcattttgaatgcctgctcttaaactggaaaattcttcgaattcatgaactggtggaagatgcgcagccaagtgtagaatgttgttacctttactgtccacttctcgttctatagactcttttaatgtccatggtatcgtataaaatattcttttttttttttgaaatagcacaaccaagtgcagtaggttccgtccattttcggggtcctttattctcactaattcaggctgaatttcaataatcaacagcacagccacattatttcctgattttattgcatcaaacagcactgacgaaggattagttatctcgtctatcatccgcttatgttccaattggttaacttgagtccataattttttaaatagccgaccaccttctgatctctcgtcctccatgtctagtaagaggtatatacaatgttatcaaaaccggttcggtcattgacccagtcgagatagtgggtcagtgggtcagtggttcaaccggtgggtcagtaattggcccggtttggcccggtctacattaaaaattttaaaattatattatatataaatatataactaatattatttgattaaaaaaataatataataaaaatttaaaataacaattgaagtattaaaattgataacacaagtaaattgtattaataatgtaaataaaaattatttaaatttaaacactaactccattttctaataaaaaaacaaggagaaggagttcattaagcaaaaatgggagtgcaggaagcaaatcttttgtggatgggcccaataaataaaccctaatcagcatgtatatataagtaacttatttcctctcttccgctggccttcactgttgcgcctcttcccattcagttccactgttgcgccgcttccctcttcagtgtcatgctattcttcttcagcaaatggcgtcgtgaccgtcgtctcttatgggcggacgacgaggttgacgaccgtgcaggggcagcatgagcacacggcggtgcagacgacggcgtgaaggaggaccgatatgcagaaattgaaggcagagcttgatgacggtaacatctatgatgacgacggcaacggcggcggcaacgccgcagtctaagtataaagccagaaggaggaagtgccgggttcctaaacccgtccgggtagccgggttcttcaaaaatcggctggttcttgccgggcttaaccgagccacttgcatggccggtccgacacccaactcggcctggagctaccagcggttcccggtctaaccggtccgaccggccggtccgagccggttttaataacattgggtatatatatagttgattggtccaaccaatgtttaacatgaaatgaaacaaacaaaacttaaatttaaattttattcttatatataagaagcaccattttttatctctatttaaaaaattatatattttaatccgtacatgaaaaaaaaaatgtaagatatttttgcacatgtggctcatgtgttgccaaacattaatttgtgttattagaataactcaacaaacatctaataccattattacactggatatagatatttaaggactaattcttaatttttttatataaaacaaatatatataactttctaaaataagaatcaaaatggaaattaatgatgtcaaataagacctaaattttagcttagcacacacacacaaaaataaaaagccattttcaacatgtgaaagcttacctaaattttttggagactttcgcgccagcatatgcaatgctgtaaggttctcttcatttcttgcaatggccagagtagttagatgttttttcaaataatcgcattgccgaatctgttatatgaacaaattaagcaaaactccaactaaattgaaaaaccacgtacttagttcatatatatctccttttatatatctgttatatgcacaaattaagtaaaactccaaccaaatctgtctcgacgtattgctagatgaagagttgtgtctccacttgagtttggtattagcatgtcttctggcctcatatgcttaactaactctttcacaattccatcccagggtttgtttactgctagatgaagagctgtgtctccacttgagtttggtattagcatgtcttctggccttgatatacgtctagcataagcgtttttccaagcataattagatcataaaatgcatgagaatgaatgataaaagcttataaattgcataaatgttgactaaagtgctttgataatgttttaatcaattttgagtagccaacaggtgaaaagagccaaaggaattccagaggaagcagagtcaaaaccttcgcgcgatccgcgccgttcacggcgctagtagcgccacattcttcaagtgacacgatccgcgtcagatcccgcgccatccgccgcgcgtctagcgccatagtttcatcagtagcgcggccagtgccaagtgcagcgcgatccgcgccaatgctgccctggaagttgaatttcctctggaagttggcgccaaccgcgtggtgtgtggcgccatccgcgccatagttgaagtgggaaatgcagttccactccacgcgacccgcgccgtacccacgctatccgcattgcttcagcgctgacagcgccaactctcgcgcgatccgcgccacacttaaaatccgcagttcttctgtgctgtcaagggtaaacttgggatttctcttcccgaagtataaatggaagaacccactgctgaagaaaggacttttgggcgaaaaatcaaaaaaggaaaggaaagaaagaaagcttggaagcttagctagggtttggggattgtgaggtcaagtgggttcttctccttcttctcctccttctccttgcttgtgtatcagctggacatgcttctttttgctgtaccaaggccaaccatgaataggtttggctagttctattttgtagctagggccaagcacttgatgtaaatcccgtttgagttgtattgaatgctcttattcattaatctaaagctattttattgcactttgcttgaatgttcatatctcttcttagacttgatcaatctattaaggtttttagagctagggttcacaataggaatgttggggctttagtcttggaactaagtgtgatagcttgctttacattacctaggaatgagaatgtatgtgggtagtttattcattatgttgcttaatgcttaaccctaggaaggtgactaagggattagaactttcaagtgggttaaagggttgtttaactgaggaattggtaaacaactgaacttagatgcacatacttgctaaatagcttaactaatcgaatataagtacgcaatacggaccatttgggaggaacatcgagtgtgggtgcattggctacgcttcgtttatactgtgaaaacttaatttcttgttcataacttagtttatgttttcaaatatcattttactttacttgttcaaacaaacaatcaatacttttaccaaaaatttgttcatccaacttttagatttaagttataatcgaatcagtgcactaatcctcgtgggaacgatatcttacttatcattttattatttgaacgaacggtatacttgccgaattcgcaacaggcctcatacgcttaaccaactctttcacaatttcaaggttgttgtaacgtactgctagatgaagagctgtgtctccacttgagtttggtattagcatgtcttctggcctcatacggttaaccaactcattcacaatttcaatcatgtcttcccgtgctgctagatgaagagctgtgtttccactatcatttaacggaatgcgtaccatatcaggacatttatcaataatcgattttgattccagccacttcgccagatatatttgataccccagatcttcttttaaagaacctgcaatcctttcaaacttcacattataacatgtcctttatatattaatcataacttttactatttagttgcaaagaagaccattttaatttctcgtttaccctaaatctgtaaaaattctcttggaaacttgtcttaaattttgaattcttaataatttcatcatttgtaatttgaaatctaccgatccaatcatcaatcacctttaattaagtttgaaaattaattctatgatgataagtaaaattgtttttgagagaagtaatttatttttttattttcttcagttgacaaaagctaattgatcttaacatgtgacttatttatactcactttaaaagtgattctactttttttatctttcgaataaaaaaaataattttctaaacccattgttgaaatatcattcgtataataatagtataaatatatttttattaacgtcaagtggtttcaaattcaatttttttgaaaatgtaaaataaacaaactcttaagacatgatctctgaaatgcaccctcttgtgaatgcaatagtttcaagtataacttactcagctcttctggagtcatttcattcactcctctactttcatgttttggtgccggcgagtttgttgaagtggcaattggagtttgctcatgactttgattaatttgaattatgtggtcatctgaaacttcgatattggagttcatgatttaattctagggaaaatgaagtgatttggagacctctctgaaactccctgttctataagtgttgcttctttctttccagcgtgcgaagcttgaacatattatatatggtggtaaaacaagagcccttaattagttttccaacttacacttaaaataattatttcctatatgacattttgtggattacagcaatgttcaatctgttcaacacctcaaccctacagttttcaaaagctttttaagttgaatgatttctaaatttataaaattaattcttttttaaagtaaataaatatattcattaaatttgttaacacaaaaaaatatatccattataaaaaaattatattcattaaattgtggggattagcgagactcagctatcatgacactgttaattaacttactctcaatttaatattatctttcttcgttgtacgattgatatgctgctagcacatcttagtttttagggtaaattaattagtaattcatataataattagaaatataggttagaattagttaagttatttatttatttgctattatctcattttattgttattttgttattttagagttaaaaagaggagaaaagaagaaaagaatcagaaccaagaaatatttgtcacaaaaataaaacaacaaaagggtttagttaccctaattaactatatggacatggaattataaatagggacttaggaggccaagagaagaacacacagaaatacaaacagaaacacagtgaagagaagatcaagaccagagattgaagaggattaatgcttctgctctctttgtattctttgaggttagacatgaacatgtctggctaattttctttattgtggttagggccaaaacccaatgtgaactcctctgtaatttgattggtattaatttgagattattatgattgctttgttttactctgttcttcattgttatattctttcttagaattggccattctatttaagttctgagggttaggattcgcaatagggatgttgggattctaatttctgacatgagtaaaataacaatttttacattgcttagggatagggatgtatgattgcagaactttatgatatattcttttaaatgcttagcttgataggaatcgctaaggaattaggatttttgattgggttaaagggttaaattgctaaggaattaagatttgactaaattcgaaaagatacatcctctgagtaatcaaaaataattaattttaataaccaattcaagtgaaagaggtagggatcaaaggggattatgttctaaccacaatgatttctcttaactgcgtctcaatccattttaaattgcctttaatttcttattaatttctgtcatttatttaatttactcaatttcacaaacaatattaattttccaatctattgttttcttccaatctcttagaacataagttacgataaaattagaaattcaatccctgtggatacgatactctacttactcactttattacttaaaacgaacggtacacttgccgtttcgcaacaacgatgatatgatagcgtttgttgtatatatattatatatttatctaactttggttgacacattgaattctatgattatttatccaacacatttttataaagttgaggaagacgcaggctaggatgggagcgtgtaattactctcaatttaatattatcatggtcactagtttactattatcgtcaagaatccaactaagagcctcatcatttcgatatatatttgattggtccaacaaatgtataacatgagcataaagaaacaagttaaattaaagtttggtcttatatgaaacatcatttttttgacacacataattaaataaataaataaaacacaattcgcaaccgatcatgaatgctttcttagaatttctgaaggctttcgcgccagcatatgcaatgctgttaacatctcttttgccccttcatctcttgcaatgtccaaatcagttggatacttttcaaataatttcattgccacatctgttacatgcacaaattaaatagcgatggtggattgcatatgtacaaggcaaggtaaaactccaactacattgaaaaaccacgtacgagttcaactagataaaaaaaaaggatgtttggttttacactgaccaaacatgttgctgctaatggtcataaaaaacagtcgttgaatatccttataaaccattttttgaagcagattctgagaggacaaaatttgcaccattttgttgtggccatataaaacagccaattcaagcgaactggaagcatcccatctgagtttggtatcagcctagaacaattagatctgcaattctcatgataatgtgctcagtctcattaagtttccctcttttgccttctatttttcacatgcacaaacatgattagacgtgtaaatgatatctacagaagaaaattaaatgttgggatggtcttgcttttggaacatgagttgtttgttctagtgtttaccttcactttctagtttctaaaatgtctgagttactttgcagaaaacagtgagtgcagacttttaatgtctttgattttctaaaagatattgtcagcagggtttctgatttaggtggttctgttgcaactcgtgatgaccatactgtcactaagaggtttgtgctctgattaatactcatgttacttggaacatgttttcagtgtggtgaattttgtttattttatattaggaaagatgatgataatgacagccacgaggagcccaagagaaataacaaggtaatatatcaattacttctcagtagttagcttaaatttttcctgtgtgattaaaccttttgctgagtaattatctcttgtctatgcagactgtgaaccttttgctggttacaaaagaagttgcttcactgacttgcgaatacaagtacatttagtatagtctgtaaacgttactatacaaagaaccaaaactatctggtttccttaaaacttttggtgaaaactgttgttgtaattgagcaaactattcactatagaatcagcactagcacataatgtggaaattctagctcagagatgcaacattcgaaagaacctcgcagcagcttgatgttaaatattatctgaataatgaaatgtttttatttttcatgatttgcacagagcctggacattgcattggcagaggaagggggtatcaatgtcagaagagaagcatgaggaataccctgaatggtccttgtctgatatggaacaaatgaacattgatcccatgcaactagctaattaactttaatggaaggattgatgaagatgaagaggattatgatgaagaaatgtagatgaacctgttttggtttagaaagttctaattgagaattatagtagaatttttaggagtagtattagacaaatccttagtggttaggaagattaggagggataggacattgaaaactttagtccttacaacctttgtttaaggataaaagtggaaatatagattgtccaattagaaatagccatggtattgttatttgagaaattttaatgtcatataggtcttgcctatggtagctaggcactacattcagatccttaaacatagggattttgattttttttgggttgttagctttgattgtggcgttgtgcatgtaagtctgttattgtatcacatgtggaaggatgtcttatttagatgaattgaaataaaaaggaaaaaatgtaattttttatttgtttgaataaataagagagtagaaaacaaaaatatggtcgttgcaaaattttcatacaaataaaaaatcaaatttaatttgaaaaacctgaactttttatttcattatttctcaacataaaaatattttgttacaaaacaattatttgatttttaaaaatttaaacataagtaaaagaacactgctaaccatttctccctccgtttcacgtctcttagtgagaaatatggtttttgactcattaattataatttcatttctcattttctaacacattcaatcaagaatatttttttatcattttatttctcttcaagttaattttatatttattataattttgttgtatatagtaattcttttcaaatggagtaagattatgtctcagtgaaagatgaatgtgtaataaaaaaaaaaatctgtgttatgatttgctcccttcaccaacacatggaatgatggaaggaaggggaaaagctttgacgtgggttatacagtatagtctcaaattaaggcggaaacaataagaaagtaatatttcatgacatagaaaatgtagaataatctcaaatttaaacacaagcttaaatattattcaacacatgattaagaatactttgccttaaacaatgtctgtaatttgtccagtttggacaaacgataaaatctcgaccacaaatgtttgtcgaaaaagttaaagtgaaagagaacaaacagaagtattgggaaaacccccattgaagccactgcataagaaacccacttggaagtgtgttcaaatatcaaaaaggaggctgcagtgaaagccacaaccatagcagcaacggagataataagtaaccaacgcccaaaagtcaagctgggatgtagtgatatcacaaattcgctttgtgcgaatcttgatgaagtgaaatttgataagaatgagagtaaagacgcagaagaagtgaataatgcgactgcatttgtcaatatgaagacagtaaaccacacgttggtcttatcacctggaacagtcagagcagccgcaaatgctacggtagcaacaagtgctgacacaagcatgccagattcggctattcctttggctgtttccttaatttcttcagataacatcttgtgttccttataaaatacatcaaatggtgtcttgcccatgttgtttctcattgctcttagttcacgaggaacacacgcctccacggactgtttacaaatcaagtgtatatgtaaatgatggtatccaaatgcataacttaattaatctttcaattgtcacttaataacgtacagcaaattacaacaacactttatgaggtttagtaagggttgagggaatgttaatgtaatgttttcaatataacagatgttagtgtaatttttcaaacttaaaagaagttagtgtaggaaaataaaaaaataaaattatatataattacacgaaacctcaatgaattattgtaatttgctttaataactattacatattaaagttgtaagaaatacaattttaaagttaagatattttaaaaataaatcttgcgggtgatatttgttgttacaaatgcacttctataatttttaattaaaattttctatcgatctatatattgcctgtttaactattatgcatgctaaagacaatggataacaaattttaaaaaattgttacaataatcaacaaatactacatacaatgatttctatttttaattaaaacttgttactttcaaggatttaaaatcagtctagttaacaaaagcctaaaatgtgtggaatttttaaatttttaaaaaaagattgctagaactgatggatcccatgccagtgaataaagaatggttgaataagaaaaactaagcaaattaattgaccttgaaccatgcgagatctctttccattttaatccttgctcttaaactggaaaattcttcgaattcaactggtggaagatgcgcagccaagtgtagaatgttgttaccttcattgtccacttctcgttccatatgctcttttaatgtcaatggtatactataaaatattcttatttgttgaaatagcgcaaccaagtgcagtacgttccgtccattttcggggtcctttattctcactaattcaggctgcagagtgctaataataaacctcaaatgcacatcatttcctgattttattgcatcaaacagcactgacgaaggattagttatctcgtctatcatccgcttatgttccaattggttaacttgagtccataatttttcaaatagccaaccagcttctgatttcttgtcgtccttcctgtctagcacgtggcctatatatagttgattggtccaaccaatgtttaacatgaaatgaaacaaacaaaagttaaatttaaattttattcttatatataagaagcaccattttttatctctatttaaaaaattatatattttaatccggaaaaaaaaaattgtaagatatttttgcacatgtggctcatttgttgccaaacattaatttgtgttcttagaataactcaacaaacatctaataccattattacactggacatagatatttaaggactaattcttaatttttttatataaaacaaatatatataactttctaaaataagaatcaaaatggaaattaatgatgtcaaataagacctaaattttagcttagcacacacacacaaaaataaaaagccattttcaacatgtgaaagcttacctaaattttttggagactttcgcgccagcatatgcaatgcggtaaggttctcttcatttcttgcaatggccagagtagttggatgttttccaaataatcgcattgccaaatctgttatatgcacaaattaagtaaaactccaactaaattgaaaaaccacgtacttagttcatatatatctccttatatatatatatatatatatatatatatatattacggtatctaatgggttcagtgggttcaattcagtttgtaaaacatcataatatgtaaaagagaactacattaaaataaggagaaataaggttgtttaattcgttttacacttactaaacatgttggttctaatggtcatgaaaaacagtcgttcaatatccttggaatccattttgtaaaaaaaattcagagaggacaaaaagtccactatcctgttgtaaccatatgaagcagcaaagtgaagtggaagcatcccatctgagtttggtattagcatgtcatctgacctcatatatataaccaactctctcacaatttcaaacctgccataacgtactgctacatgaagagctgtgtctccacttgagtttggtattgccatgtcttctggcctcatacagttacgcaactcattcacaatttcaaggctgccttcccttgctgctacatgaagagctgtgtctccacttgagtttcgtattaccatgtcttctggcctcatatgcttaaccaactcatctacaatttcaaatttgctgtgaaataatgctagatgaagagctgtgtttccatatgagtttcgtattggcatgtcttctggcctcatacggttaaccaactttctcacaaattcaactctgtctcgacttactgctagatgaagagctgtgtctccacttgagttttgtattagcatgtcttctgggctcatacacttaaccaactcattcacaattccacccttgccttcccttactgctagatgaagagctgtgtctccactatcatataacggaatgcgtaccatatccggacatttatcaataatcgattttaattcgaaccactcattcctccatatacgtctccacagatcgaattttaaagaacctgcaatcctttcaaacttcacattataacatgtcctttatataataatcataacttttagtatttagttgcaaagaagacccttttaatttctcgtttaccctaattctgtaaaaattctcttggaaacttgtctcaaattttgaattcctaattatttcatcatttgtaaattgaaatctacctgagaaatttgagattatgtattagtcgaagggatccaatcatcaatcacctttaattaagtttgaaaattaattctatgatgataagtaaaattgtttttgagagaagtaatttattttttattttcttcagttgacaaaagctaattgatcttaacatgtgacttatttatactcactttaaaagtgattctacttttttatctttcgaataaaaaaaataattttctaaacccattgttgaaatatcattcgtataataatagtataaatatgtttttttttaacgtcaagtggtttcaaattcaatttttttgaaaatgtaaaataaacaaactcttaagacatgatctctgaaatgcaccctcttgtgaaggcaatagtttaaagtataacttactcagctcttctggagtcatttgattcactcctctactttcatgttttggtgccggcgagtttgttgaagtggcaattggagtttgctcatgactttgattaatctgaattgtgtggttatctgaaacttcgctattgtagttcatgatttaattttagggaaaatgaagtgatttggagacttctctgaaattccctgttctataagtgttgcttctttctttccagcctgcgaagcttgaacatattatatatggtggtaaaacaatagcccttaattagttttccaacttacacttaaaataattatttcctatatgacattttgtggattacagcaatgttcaatctgttcaacacctcaaccctacagttttcaaaagctttttaagttgaatgatttctaaatttataatattaattcttttttaaaataaataaatatattcattaaatttgttaacagaaaaaaatatatccattataaaaaaattatattcattaaattgtggggattagcgagactcagctatcatgacactgttaattaacttactctcaatttaatattatatttcttcgttgtacaatgatatgatagcggttgttgtatatttattatatatttatctaactttggttgacacatttaattctatgattatttatccaacacatttttataaagtttaggaagacccgggctaggatgggagcgtgtaattactctcaatttaatgttacctgtcttcgttgtacaatgatatgatagcggtggttatatatttattatatatttatctaacttccgttgacgcatttatactagttatagtcaactactccgataaccattgaattcaaagcaagactagatgcattttattatcgaaaaatgtatgaattttattaaactcactacaataaccagaaatcaatgaccgtaaatttaggaagacgcaagctataatgggagagtgtaatgggtcttttacagtcagaaagtattttatcaccatcagattatcttatttaaaaatcaatgaccataaatttttcttcttttattattatttttcctttttttgtcctcctctttcccgtactaccatcttcctctttcttcgtctcgtctcttcttcccattcttcctccttcgtctaagcggcaacggtggtgccatgacggtcgatgatagtagggatgttgattcgtcgttgcctgaccgttgtgcggagtaaactagagagaactcgagagggtcttttgtcgtttttcttgcagtgttctgccacaagatttcaaacaagagaaaaagcatggaagacgaaacagtcacaaagcttgatataattattgcctcacttaaacccaaattggattcatttgaacaaacccaaattttagtctcccaaagttttgagctttttgatattttttgtgtacgtgttgattttttctcatgggtgccaagttacgagtttgtttcttgcataaacgttgtttgtataccatttttactctcaattttgagtccaatttggaagaataaaagacctaagattttggttttgaaaatcatgacattttttatgacgatttgtgattatatttgaaattgcagtttcaagaaaattattgtaccgttgatatgtaatatttgtaacctggccttgttttctatgtggctccaccactgtagtgaccatctgtggatgtggaatagggaaaaaggaggaaagggaggggttgccgaaaattgctttctgcgtaggtgtcgttgtcggatacaagaaaaatggaagaaaaggaataaatcagcaatggtgatgaataagccagagcgataaattggatggtgcattcctgtgtgaagaaattttatagccgaatttctattgacacagttacaacatatgagtagtgatatgtcttattaaattggatgatgcattcctgtgtttatcactttattcgatctaaattcctctgtggatattaattaaaaaataggtccttgactgtttgggcaagtcctcgcgagggaaccttatttgttgaaccatgtattacatttttgtttgcttggaactataataacatatccgtagagagagtctcacaccctcaaatacactctttttatcccactctctttcattgttccatctcatcttattttttaacctcgtccttattgatcctcactcaacctctttgccaatgaataaaataaaggggcaagttacttgataggcatagggatagacgatttttggttctttaaaatataaataataaaacaaaataaaaacttataaagtgtcataacctgaataataaccggtaaacaagtaactattttaaaaaataaaatgagatgaaccgatgaaagatactggtgaagaaaagagtgtgtttgagaatgtgactctaatattcttccttattttattgtagatgtattttcacttttttttcatcttgtccttaaaaactaaacaaaggaacatttttttgcatcacttagtgcatcaattggaaacatttagctatttacgcgtaaatacagaataatcaatacgtaatattattagtactcgttcatattgaaataggatgccaaatttgtactgccctacgcccctacaccgtctgtacgtaccattatatatagtagctgcatttattccatacaataaatacatataacatatttaatactaccttcgagtttttttattctcttacattacccttcgaaggaataatgcaatacatacatatacatatatatactttaactttcaccttgcaaccatttataatcttctgtaacctgaaaaaaaaaatatttttttttcggtccatatatttttttttaataaaacttgattttagttctcaaattttagttttaattaatttaattctcgaattttataaaaagacaataatttgttcctcctcagaataaaagtaatgatgaaaccagtattatttttctaaggtttaaagattaatttgatcaaaatagaaatatggaaactaatactatacaaataaatatttatcgagaggacagagattaaaagtatgccttattatggctagaccgacaccgaaagaggattaacactgatgggcttgaattcgaggacctccttggagttcaaccatgacctaacccacactttcgtttcatacacatttttggtttcaccatgttttgcttcctaagtgatgtagtatatgaacacttccaccacctgctgctttgcactaatcaccctcacaaactccagatttgcattctgcatttccaactccaatataatcaccacaagtataaaaatagagataaattaaattaaacatgcatatattaagatgttaattaattcttaagttgtaaagttgaaacttaaaggaagaaaattaaagaaagaacctctttattgttgtattggtcaacagcaaaacgagcgagattctcgatctcgacgctgttggcagctccaggcacatcggttatgccacctgttactggctcttttgtttctgttgccatttctcttttctttatcttctctacatcactactattctacggctttttatagggaaatatcaatgcatgtttatcttatctcattctgattgaatttgagtggtaaacaaaaaaagatcaagagatcgaatgaaagatgaaagatttttattttatcttatgcaaatattgtttttgaggtaattatatgtcatgcattaaacgtggattcttattctaataagaatttgaactattattcgatccaatgttgtaaaagaatagtccattccattttacctaaatctaatatttttgaaaaatgttagtaatacattttaaatatgatttttttcctattgattgaaattcttttagatttcaaaattttgtaaatcttacgtcttatttaatgaatttatttatgattttggagcatttaataaattttaataataataataattaataattattattttgacatgaatatgttaaaaaactgttatgctagccttgatctccgctactgagtgtgtatatttaattactatttataacaattattcatgtacgttttttatgttttttattttaaaaaaaagcatttttttaactattgcatttgcatatgtgtgaccaatctcagatattccctttgtcattaatatttaacaaaaagcatttttttaactattgcatttgcatttttttaacaaaaatttcatattctccgtacgtcgttttgtcgtgggtgtttcaatgaattactgcagaagaataagcgggacacaactaattaacttcaaccttgacatttttggatactaattgtggacacaactcacccatgatttaagcacgtgtttggatgtgaagtgtgaactacgatattatgtctccattatgagttggttgtgaaactgtgaaagctggtacactatgtttggcagagatataatagatagaagaaacaagaaaatgaggatgatatggaataaaaaattaatgatggagtatatttgataaaagagaaataggtgaagagagaattaaaaagatatatatgaaattaacgatgactagaaatcgatagtaacttctccccctctctaatttgtatttctcttaaataaaatttatattttttacttagttttcacctatttttcttttctcaatttttatcaactgtatttctctttaaaatttatttgtttctttcgtaaagatccggatgtatcctatttttatttctcttaaattaaatgtttttatttttacttagttttcacctattttatttattatatttttcttctctccatttttatcatctgtatttctcatttcatgtatttgtttctttcgtaccaaacaatccgaatggaaaaaaaaaacaatcacgttgctgattcgtgaccatacacgttactatggatgtgaaaaagagatatattagatgcatgctctttacaaataatcatcaacataaaatagataatgtcaaaaagaggcatattagacattagtagcaccagaaaaaataaaaatgtgtcagactaatcatcaaccactagattcataaacaaggcttatagtaatgagttgatggatctatcataaaatgtatttagaatagctgtggaaaaatattaattgttttaataattgattatatgatattagttttgtaattcgatgtattatatggaaaatgattttgagataatttattttatttgaattttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatctaaccttgttatatttttgtctcttttctatcttattttttttacataaaaatgtaaaaaattacaatataaaaaataaagtaaaataatcacatatttattatgttataattattattatttatatttaaattatatttatatattttatatttaaacataattaaatattttaaattttaaatttttgtcaattcttaattttatatttatcacattgatataaataatgaaattaccaaccgaaatagcttatcgctcgcaaattaatagtatttttagcggatggtaaagtcagtcgcaaaatagcacaggtgacattgtttttataagttttacaacgataacgaccgaaatttcagtcgccaattatgaaaaatcagcaactgattattttggttgcaaaatattataatcagattccttcactgccgaaatagacttcgataggtttgcagccaacataccgttgctaaatctcaatatttcttttaagcttgaaaatagaagcagtcactatttgtgaccgatgggttgtactaaaaaacattttgttgctaaattgagattttttttcttgtggtaggtcaagcttaggcttatgaaatcttagccaagctttaaaggtttaggaagtttattcaaatttataatcatagatgatagttatagacgaatttctttttaattttttcacaattcatttaaatttaaattttgtaaagtaaaattattttaaaatattatgacccaattaacttaatctaattcaactcattcatgatcgatcgagtttgtttcatagaaaatttttcaaacacaatctaatctagcttaaattttttgattggattgagtgacaaatttagtcaaatctaacccaacctaacttgtgtacacctctaatcagtgtactgttcaacgcataattcttaatataccaacatattagtttaagtttcaattgtctatataataatgcaatttgaaaattaatttattagttgtctaatttattttttaggtttgatttgattctctaaattttttgaaatacaatttgatcttgccttctaaattgagccaatgatattaaaaaataacacttgtgtgacatcttaaaaacacttaaggatgattttaaatgtcacaaaacacacatttaaatgatatgatcattcaaattaatttagacaatataaccaaattaaattgattttaaaaattaaataaccaaattgaacccaaaaataattagaggattaaattaaactaattttaaaaattaaaagatcaaattaaattcaaaaaattagagaaccaaataaaaagttaaaaataaagtagtgaaaaaaataattgaacctttttatttatttattgacaaatgataaacgcatttaattttaacaaataaaaattgataaatatttaggaccctgcccaaatccaaggagggcaagtacttcatgattgtgacctcataatcgcattgagtacagaagacaccgcaccaccagatcattctgctataaagtttgaatcatcaccatccacacattggacgaaacacgcataaattaatacataatcaattattttattaatttcgatggaaatatttatctgtagtaatttatgctgaaataggatggcaaacatgcacggcaaaaaaaatttatttattgtagtttaaataagaaattatcaaaatattgcagtttggaaactattttcaaatctattgcaatcagtcacgtgcaaccaagacgtgtttaaacacatcgtccctggacgtgtttaaacacgtccaaccatgacgcgattcaacaagcattcacgtccacacaggacgtaacccagcaccagtcacgtcgtccaaggacgtgaccctgctcccctatatatacccctcattcagcgtttgcgcccatttttagcatttgcaaaggtcttggctatctctgaaggcttttgttctatgagttctctttggattcggcttttagttcaagcaagtaagtgttggtcaaacgtattatttttaaattacatgaaatatattgagtttgtcaaacgtattatttttaaattacatgaaatatattgtgttgttggcttagagaattgatattgatgtagaaaattgttattgacttaggtttgaaatagttacttattataacgtaagttttatgacctaggttttgattagttatttatgtatgttaagacctaggtttattgagttacaatattattagttagttagtcagattatcattaagtacgagttcaaggttatgatgttggttacgtaggttatgacctaggtttagggtgtagggtacaattagtgggtgagctaggttttgattagttatttacgtaggttatgacctaggttttgattagttagttttgtaggttaagacctaggtttattgacttacaatattattagtttagggtttaggttatcattaagtacggcctcaaggttattaccttggttatgtaggttatgaactaggtttagggtttagggtacaattagttggtgacctaggtttccattagttatttacgtaggttatgagctagattttcattaaggacctacataagacatagataatcaattttttcaaataatttttcttctaaattaaattatcataatatgtttttagatttttctgtgttacaggcgtgaccatggtcttgtgttcaccatctttctgatcttgtagtcgttggtcatagataaaaaaatgtctggagatggtgattttgttcgtattgttttatattataatggtagcaaaattgagagccgacgtggtgttattttcgaaggagagaaaaggggaacacgtatcaatcacaactcaaccattgaagaattccataaaaaaattagtcaaaaattagttctcaaaggcaatgtatctatcactatggtcactgcaagaatatggtgcgatgataaatatatcagcatgaaagtaattgacaacgaagactcagaatttgtaataggagaattcttcaaccagtcaaggaaaaatttcttagagttgtatgtggattttgctggaatagagaatgtggctttaccaacgaggtcaattgatttcaattattctcgtggagcatcagcatctgctgctccagttgttaatttttctatggaagatgaaaatgaccctacttgggttatggatgacgatgatgaaaatatcgcaatggaagatcgtcttcttgctgagaatgctagtgcttcggacaatgatgaggatgatgtcgaagcgcatcacaaatacaagtacattacccattcgtgagagagcatgaaatccaacgacaagaggatgcaggggagtcttatttaccgcaacaatgtcaaggtgtgttaccaaacaatagttacttacatatatgtttgtttattatgtatgtattttattgtaataaatttgggaatttgcatatgtaggtgagggtaatactactttttaggatggaatcccacattacacctacattgattgggattatccgagtgaacaagattctggcagtggttatggttcaggttcagttgagggtccatgggtattagggaataagttgtttgtgaaacagaaatttgcatcaaaagaagacgtgcaaatgacaatcaagcgaaacctcatgaagaagcatcaggaagtggtcgtggttgaaagtacgccgacaaagttaagcatgaaatgttgtgcgcatgaccagaattgtccatggagggttagggtaatgaaaccaacatacggtgaaagatgggtggttaccaaatggggtggcaactacaattgcttaaatgatcacatatctcaggaccacaaacaacttgatgttgatgttattgtttcactcgtactaggtaagttattggatgagatgataatgatgagaagtaatgattttattgttattattaatgataacgtgattatttttttattattagggatgataaagcatgatccatcatgttcaattggactagtccaggaaaggataactcattcctatgaagtttcatatagaaaggcatggtatgcaaagcagaaagcaatggcaattatctacggtgattgggaggaatcatatgcatttttgccgaggtggtatgaatacatgcttcgcttttcaccaggttctgtttatcaaattcagacaaaaaattattatgtggctcatagaatcgttcatggaaaacgcgtgttccagcgcattttttggaccttcagacaatgttgcgaggctttcaatttttgtaagccggttattcaaattgatgacactcatttatatggcaagtacaaaggaaaattgttgattgccacagctcaggatggaaacaatgagtgtttgccacttgcatttaccattgttgaaggtgagacgttggaagcttgggaattctttctggataacattcgctcgcatgttacaaagaagacaaatctttgtcttatttctgataggcatcgaagcatgcatattgtctgcagtggagaggcaccccgggtggtaaccaccacatgcttatcacatcttttgtctccgtcatattgcgagcaattttaatcaaaagttcagaaatgaaaatttgaagagagcggttatgaatttaggtatggttaaaaactcatatattcatttttcatgtataactaaattttaatgttatttaatttctgtgcaggttatacaccttctattgttgattttgacatagcctttgcaagttttcgtgatgtgagtcctgaggttgcaaactggattgatagcatcctgaaggaaaagtggacacgtgcatatgatgttgagggacgaaggtatggacatatgacaacaaatttggctgagtcagtaaacaggattttgaaaggtgcaagaaacatgccaataatcacgttggttaagcacacatatagcagattggtgaaatattttgtttgcagaggccgatcggctcttaatgaattgcaaggtccttatgctcattgcaaaaatgtggttgttatgttgaaggccaatgagaccagttctactggtcattatgttcgtgcatttaatgttgaacgatctgtatttgaggttgacgatggttatgacaaatcgtactcggtaaacctccctgagcggttctgtcagtatgggaaatttaaggtgttcaagtatccttgtagtcatgctgcagcaaccgctttacatgttcgtcagtcaccggcacaatatgtggatgacgtattccttataacaaacctgatacaagcttactcatttccatggtagccaattggtaatgagcaggcaattccacctagtcatgatccagtggtcatacctgacaggtctatgttgcgtgcaaagggtcatccaaagtcaactagaatacgcaatgagatggacgaagttgaagctagtcaaagtcgtattaagtgtggtatatgcagattacctggtcataacagtcgaaattgtcctagtcgtccatctatttcatgatttgttgatgttgttgtcaatgttttctttatgttgttgtatttcgtaaggaacaagcgtcaattacaaacattggcaaaccgtaaaactatacaaaagcaaaaaaagaactaaacaaaaacaattttcttgaacgaatcaacagcttaataggacaagatctgaaatcaaatatccatccaagagcttattttgaaactttaatacattatgatgcccgagtaaatccataaaattaagcttttcacaaccattaaatccatttacaaatcatgcatggctacatctttgacaattagattacctgttttctctaattgtatgtgcctgtttgctctttcattttctccgtatagactacgaatgttacaatagaacatgagtagcaatatagagataaataaatgcaaactaacaaaatgataggataaaacaaaacaagagagatcaaatttaaggtattgtgtttgttactttgtttgaggaagatattcgcactcgaggttgcaagttgcaacgagtattagaaaaaccgtcttcaaattggacaattcaactactgaactgctcaaataacatgtctaaatgtctcactagtaggctactggatcgatttgcaattggtcagtagacattcttttagtttctttctgttcacaaactcttttttagcttagcaaaacttgaaactaattcttttaaactaatttggtttagtttggttcacaggaacaatttggtgtaatctctatgttttggttcagagcaccaaaacagttcagtttgattcaaagcccgaagtccaagtatagaaataaattgtatgcacttgtgtgaattttccatgcctttctttaatttgctgacataaggggatatattagagcttatcatcagcaaaaaagggtttatcgtcgaaggaattgaagtttagctaaataagagaaattgaatcacataattaagacgagcaagagattatcttagggtggattcaagggaattccaacacctaaccatttttattaattgatttttctagtacattattcaattgtgctcttgtttctttcaattaaatataaaaaagtccaaaaactcctaattgtttatctcttaaatcaaaagtaatcgataatttcattgatgtattgttgataaaccaaattttttattgatacaataatttctccttattttatcaattgtatacaactagtacacttatcgtattctcaacaaactacaacaatatactggtagaaggtgactcagttgatctttaagtcactttacgtgaagtccacattgcccacagtaggattagtgttagaatacattacagttcagagtaaactttcaatttaatttccatagaaataaacgtgagggaaataaagttagtagaactgtagaaatatagattacacagtttgtttgacgttagttaatataaatgtgctttctcttgatattcaataaatttgcatgttgtcatcgttaaaaaatacaaagataaattatttttaaaatttatctttttagtttttgaatttttatttatttttttatcccttaattttttagtatgtattacatttttgtttgcttggaactataataacatatccgtagagagagtctcacgatttttaaggcagcatggcacttccgacaggttcattccattgttcaaagttggattagtgctacagttaagagggaaagccttagcccttaggcttctactgaactgaacgccacgaaaaaataatatgatgaaaaggatgtattatttagatgaatagaaataacaagaaaaaatgtaaatttttatttgtttgaataaataagagagtagaaaacaaaaatatggtcattgcaaaaatgttcatagaaataaaaaatcaaaattaatttgaaaaacatgaactttttatttcattatttctcaacataaaaatattgttataaaacaattatttgattttttaaaaattaaacataagtaaaaaaacaaaaaaacaccgctaaccatttctcccagattggaaggattgatgaagatgaagaggattatgatgaagaaatgtagatgaacctgtgttggtttattcattacttctcatataggcccgtcattaattagaatgttcttatggggaattagagtagattttataggagggatagggcgttgaatactctccttaacccttgttttaggttaaaagtggagatatagattgttccaattagaagtagccatttgccagtatagttatgacttatgcatgagaaattttaatctcatgtaggtattgcttatagtaggcactacatttagattttgggtgtgttatggctcaaaatttcacggggatgcctatcttaatcacacttgtatctagcaaaactaactcaagctccagcaacatgatttgcatgcaaccttttgaatttttggtatcgaacttattgcacgatgagacaagaggaaaagaataagacgttagacggatagaaataaatacgaaataaattaaaaagatgtgttatttagatgaataaaaatagaaaggaaataagtgtagaaattcattatttatgtttgtttaggacaaatgaaagagaaaatacaaacagatgaattgtttgaaaaaaagtatacattttttttaaaattatttccattattttttattatataacatccttatttgttttttaatatataagcaccactaatcgctgccctgtaaaaccaatctcgcttcaaactagtttgttcaaacttaaaataagtattttttaaataagcatttatttaataaacaaataaggatgatcaaaataaacagaaaaaatgttgtttaagcataaacataaagaatgatttgaataattaactactcaatgtgggacttgtgtctaccatgaggagaactttatctaaggaggaacaaaaagaatgttcttatggttttgaatatacttggaatactaataagaaagaggtgaaactaaaattccaaagtacagttaactaggtcctagctctagatagatccacatgcttacatgcctcagtccctgattggagatatatgaagtttatatttaatatggataagtcctaggaaaaacagaatagtcagggctcaatctcaaagtttggaataactataatttcttattaaaatgccgatctaaatggttcttatacttgctcccttcaccaaccacagggaaaacccctattgaaaagccactgcataagaaacccactgggaagtgtgatcaaatatcagaaaggaggttgcagtaaaagctacaaccatagcagcaacgaagatcaaaagtaacacaggctgcagtaaatactgatgaagtgaaatttgacaagaatgagagtatagacgtagaagtcaatactgcgattgcatttgtcaatacgctcattggtttggatcaattaatgtcaatgcataacttgattaatcttttaattaccacttaatcactattacaagttaattttttaagttatgatattaaaaataaaaggaattgacctagcttgaaccatgcgagctctctttgcatttgaatggttgctctaaaactggacaatgctttgaattcaagtggcagatgagcaaaatgtagaacgttgttaccttcattggccactgctcgaactatatgctctatctttttaagtatactaaaaaaaaattgcttatttttcgatataggacagccaagtgcagtaggttccgtccattgttggggtcccttatcatggtcactagtttactattatcgtcaagaaaccaactaagagcctcatcatttcctgattttagtgcaacaatattaatatgcaataagaggagaaaaatgtcgtcaaattaacaagaacataacaaccatcaacaaattgagtgtaataaaatcacgacacatatttagaaaaaattttatgtaatattttttttatttaaatttaagtcttttgtttacttatttttcttatttacaaaataaataacaatctttaacattaataacaaaaatataaaaatattaaataatataatatacaaaaatataaattaaaactactttagagctgaaaactaacttaaaaatgaaaaaaaaaatgatcattttgagacggtctctggatgttcccgtaaaaataagagtttgttatcaagagttcaacacaaagatatgtagaggtcggtcgaaacttaactaggaaggtaattaaacaagacctaatggagtgaaatatagattgacggacgatatgtcttaggacggagtggagaaaaattataagcttggtggagggttaaacccattagtatttagcttattttttctctctttaatcttatttccgtttttttcttcccctctccctttctctttctttgtctcatttccgatttatcattggattcatctaccaccgatcccaattaacttgggttaaaggtgctgttgatgttgatgttaatgttgattttgaagtcgttaaaatttttatgaagttacataaatagttaaaaataaaaaaaaaattaaaatgtgactttgaagtgactttgaagtagttgaaatttttatgaattcaatattaaaataaaataaaataagagatcaaaatcgtaaaattttttcctccatttgacgtctcttagtgagaaatatggtttggttaggactcattaattataatgtcatttctcattttctaacacattcaatcaagaattttttttattacttatttctcttcattttaattttatactcattataattttgttgtatataataattctttttaaatcgattaagattaagtctcaatgaaagatgaatgtgtaacaaaaaaagctttttctgtgatatgatttgctcccttcaccaatccacatggaaggaaggggacaaactttgacgtgggttatgcagcatagtctcaaattaaggcgggaacaataagaaaggtaatatttcatgacatagaaaatctagaataatctcaaatttaaacacaagcttgattgttccacaaacaaataataatacagtgccttaaagtaatgccaatgtctgtagttctgtaataagttagtcctgtttggacaaacgataatatctagaccacaagtgtttgttgaaaaagttaaattgaaagagaagaaacaaaagtattgggaaaagccccattgaagccactgcataagaaacccacttggaagtgtgatcaaatataaaaaaggatgttgcagtgaaagccacaaccatagcagcaatggagataataagtaacggacgcccaaaagtcaagttgggatgtagtgatatcacaaattaagtcgctttgtgcgtgttgcgaaattagcaagtataccgttcgttcaagtaataaagtaataagtaaagatcgttcccacgaggattgatgtaccgattgtattgtaactagtatctataagttggatgacaaacgtttaaaggaagttttgtgttgtgtgtatcaacgattgaaattaaagactaaactatgaacattaaatgcttatgaacaagtaaattgatattgtaacgatataagggcgatagtagttaggacaatccacactcaatgctccccaccttcttacacagattgtttactatattcattcacctcaaactactcaaatcatgcatcttcataagttgtagtcaagtcttaatcccttagtgacataacccttcaacccaattaaaaaccctagttccctagtagcttctatgaggttaagcattaaagtgatgcattaaacgatttgcaaacatacatttctatctcaagacaatgtaaagttcgtcacttcactcaagtccaagcatagaatttcaacattcctattgcaaaccctagctctaaatatctcactagattgatcaattccaacaagataccaacattcattcaagcaaagtaaagtgaaataacttgatataaatgaataatagcattcaatccaatccaaagagggttacatcaagtgttggccctaactacaaataagaactagccaaacctaatcatggttggcaatgagctaacaaaaagaagcatgcccagctgaagtacaaaggagaagaaggagaagagaaatgtctccacttgaatcttcaactcccaagccctagctaagctcccaagcctttcttcagcctttcttttgtgatatttcgtgcaaaagtgccttgaatgttgtaggtctttggtatttaagtttgggaagtgaaactcccagttttcccttgacagcttttaaattgtgcagaagtcgagcttccacgctgatggcgtggaattcacgctggcagcgtgagatagcagaacaactagcaaactttcattcaatggcgctggtggcgtgaatctcacgctgatggcgtgatattcacgctggtagcgtgaaatctcagaagagaagctcccatttctccagctagcgcgattggcgtagaacatggcgctggtagcgccaggtacttttgctcaaacaggattgaattggtgcattcctactatacaattgcccaaattagctgagaatatggtagcaaaggaataatcacaattcatagcatttatggacaattattgaagatttatgattgattccttgcttctattagcttggaaagtactatatgctaggagcatatcattgcgaatcttgatgaagtgaaatttgacaagaatgagagtaaagacatagaagaagcgaataatgcgactgcatttgtcaatatgaagacagtaaaccaggcattggtcttatcacctggaacagtcagagcagtcacaaatgctacggtagcaacaagtgttgacacaagcatgcctgattcggctattgctttggttgtttccttaatttcttccgataacttcttgtgttcatcataaaatacatcaattggtctcttgcccatgtggtttaaaattgtacttagttcatcaggaacatacgcctccacgaactatttacaaatcaagagtatttgtaaatgatggtatccaaatgcataacttaatctttcaattatcacttaataactagagcaaattacagcaacacctcctaagatctagtgtaattacacaaacattccttaggtatgagagtaaggtttgaggggatgttaatgtaatgatttcaaacataaaaagaatgttagtgtaatttttatttaaaattatattacacaaatatttattgttacaaatgcacttgtataatttttatttaaaattttctatctatatattggcagtttagcatttatgctaaagacaatggattacaaattttaaaaaaaaattgttacagtaatcaacaaatactacatacaatgatttctatttttaattaaaacttgttacttttaaagatttaaaatcagtctatttaacataagcctaaaattagtggaattttaaatttttaaaataagatagctagaactgattgatcccatgcgagtgaataaagaatggttgaataaagaaaactaagcaaattaattgaccttgaaccatgcgagctctctttgcatttgaatgcttgctcttaaacttgacaattcttcgaattcaccttgtggaagacgcgcaaccaagtgtagaatgttgttacctccatagtcctagaagctctgttaatcccggtagtataatattaaatatttctttttgtcgaaatagcacaaccaagtgcagtaggttccatccatttctgcggtccctataagtgactaattcaggattattgtcaagaagcgtctccacagcctcaacatctcctgattttattgcatattcacgattctagatctgttccaatgtttcaacttcagtcaatacttctccaaatagccgatcacaaacgtctgattccttggcaaacataaatttgtgttattaattagaataactcaacaaacatcaaataccattattagactggatatagataattaaggactaattcttaattttttatataaaacaaaaatatatataactttctaaaatcaaaatcaaaatggaaatgatgtcaaataagatctaaattttagcttagaacacacaaaaaataaaaagctattttcaacttgtgaaaggttacctgactctcctctaggcttttcccccagcatcttcactactgtaacgtcctcttcttttcttgcaagttgcaagggccagagtagttggatatttttcaaataatcgcaatgccaaatctgttgtatgcacaaattaaatagtataaggcaatgtaaattaaaactccaactaaattgaaaaaccacgtacgagttcatatatatctccttttatatatatatgaaatcaatgagaatttagctaggacctctttggttttagaggatgatatcacagtctttcataaacctaatattcataattaattatttcaactgattctcattaaatttgttattgaattatggtcaagtgtatcgaatgacgttggaattgtaaacattatatatatatatatatatatatatatatatatatatagcttatggtatctgatcggttcaatgggttcgattcagtttgtaaaacatcataatatgtaaaagagaactagattacaaaaaggagaaataaggttgtttaattagttttacacttaccaaacatgtcgaacctaatggtcatcataaacagtcgttcaatatccttgaaatccattttgtcaagcactttctgagaggacaaaatgtccaccattctgtagaaaccatgtaaagcagccaagtgaactggaagcatcccatctgagtttcatattagcatgtcttctggcctcatacacttaaccaactcattcacaatatcatcgctggattcccttgctgctacatgaagagctgtgtttccacttgagttttttattagcatgtcttctgccctcatacggttaaccaactcattcacaattccaagccttacataatatactgctagatgaagagctgtgtctccacttgagttttgtattagcatgtcttttgggctcatacggttaaccaactctttcacaatttgaaggttgtatttccttgttgctagatgaagagctgtgtctccacttgagtttcgtattagcatgtcttctggcctcatacggttaaccaactcagtcacaatttcaagccttacgtaatatactgctagatgaagagctgtgtctccacttgagttttgtattagcatgtcttctgggctcatacggttaaccaactctttcacaatttgaaggttgtatttccttgttgctagatgaagagctgtgtctccacttgagtttcgtattagcatgtcttctggcctcatacggttagccaactcagtcacaatttcaagcctttcttaatacactgctagataaagagctgtgtcttcactatcatttaacagaatgcgtaccatatcaggacatttatcaataatcgattttgattccagccactcatccagccgtatatgtgtctccagatcttcttttaaagaacctgcaatcctttcaaacttcacattataacatgtcctttatttaataatcataacttttactatttagttacaaagaagacccttttaatttctggtttaccctaaatctgtaaaaattctcttggaaacttgtctcatattttgaaaattcctaataatttcatcatttgtaaattgaaatctagctgagttaggcgaagggatccaatcatcaatcacctttaattaagtttgaaaattcatactttaaaagtgattctactttttattttatctttcgaataaaaaaataattttctaaacccattgttggaataccattcttaataatagtataggtatttttttttaaagtcaagcgatttcacattcatttttttcaaattgtaaaataaacaaactcttaagacatgatctctgaaatacaccttgttgtgaatgcaatagtttcaagtataacttactcagctcttctggagtcatttcattcactcctctacttccatgttttggtgtcagtgagtttgttgaagtggcaattggagtttgctcatgactttgataaagagtatgatcttgtgttggtataatctgaattatgtggtcatctgaaacttcgacgatattggttttcatgatttaattctagggaaaatgaagtgatttggatacctctctaaaattccttgttgtatcaatgttgcttctttctttccagactgcgaagcttgaacatattagacgtgtaaatgacatctacagaagaaaattaaatgttgggatggtcttggttttggaacatgtgttgtttgttctagtgtttaccttcactctctagtttctaaaatgtctgagttacttgcatccttgcctttgcagaaaacagtgagtgcagacttttaatgtctttgattttctaaaagatattgtcagaagggtttctgatttaggtggttctgttgtaactggtgatgatcatactgtcactaagatgttggtgctctgattaatactcatgttagtaggaacatgttttctgtgtggtgaattttgtttatttattttatattaagaaagatgatgataatgacagccacgaggatcccaagagaaataacaaggtaacatatcaattcagactgagttggcttaaatttttcttttgtgactaaaccttctgctgagtaattatctcttgtcatgcagactgtgaagcttttgctggttacaaaataatttacttcagtcattcgggaaattcacaagttgcttcactgacttgcgaatacaagtacatttaatagtctgtaagccttactatacaaagaaccaaaactatctggttttcttaaaacttttggtgagaactgttgttgtaattgagcaaactattcactatagaatcagaactaacacataatgtaaaaattctagctgagagatgcaacattctaaagaacctcgcagcagcttgatgttaaatattatctgaataatgaatttttttttcttcatgatttgcacagagcctggcgttgcagtggcagaggaaggtggtatcaatgtcagaagagaagcatgaggaataccctgaatggtcattgtctgatatggaaaaaatgaacattgattccatgcaactagctaattaacttaaatggaaggattgatgaagatgaagaggattatgatgaagaaatgtagatgaacctgttttaatttggtttagaaagttctaattgagaattagagtagaatttttaggaatagtattagacaaatccttagtggttaggaagattaggagggataggacattggaaactctagtccttacagcctttgttttagtataaaagtggagatatagattattccaattagaaatatccacagtattgttatttgagaaattttaatctcatataggtcttgcctatggtaggcactacattcagatccttaaacttacggattttgattttgtttgggttgttagctttgattgtggcgttgtgtatgcaagtctgttattgtatcacacgacgtttcctctcgagtacaaattgagagcaaatctgtggagcaaattaacttactgatccgacgacatgatttgcagttgaaccttttttgttatcttgaatttgatgagaaatcaaataaatggaaaagaaataatagagatataaattaaagtttaatatctatgtactaacgtttaacagtataaaataattttaggattttagaaattattattcaatcataaattaacgttttaaaagtaaataaatttattatatatacacaatgaattgtgattagctggttatataaatctttttacactctcaaatcataactcttatctagaaataaatacaaaataagatgaaaaagatgtattatttaaatgaataaaaataacaagaaaaaatatataaatttttatttgtttgaataaataagagagtagaaaacaaaaatatggttattgcaaaaaatattcatacaaataaaaaataaaatttaatttgaaaacctgaactttttaattatttcgttatttctcaacataaaaatattttgttataaaacaataatttgattttttttttaatttaaacataagtaaaagaacactgctaaccatttctccctccatttcacgtcacttggtgagaaatatggtttggttatgactcattaattataatttcatttctcattttctaacacattcaatcaacaatattttttattactttatttctcttcattttaattttatatttattataattttgttgtatatagtaattcttgtaagatcgagtaagattaagtctcagtgaaagatgaatgtgtaataaaaaaagctttttttgtgttatgatttactcccttcaccaaccacatggaaggaaggggaaaagctttgaggtgggttatgcagtatagtctcaaattaaggcgggaacaataagaaaggtaatatttcatgacatagaaaatgtagaataatctcaaatttaaacacaagcttcattgttccacaaacaaataataatacagtgtcttaaagttatgccaatgtctgcaactctataataagttagtccagtttgggcaaacgataaaatctagaccacaagtgttcgttgaaaaagctaaattgaaagagaagaaacagaagtagtgggaaaacccccattgaagccactgcataagaaacccacttggaagtgtgatcaaatatcaaaaaggaggctgcagtgaaagccacaaccaaagcagcaacggcgataataagtaacgcacgcccaaaagtcaagctgggatgtagtgatttcacaaattcgctttctgcgaatcttgatgaagtgaaatttgacaagaatgagagtaaagatgcaaaagaagtgaataatgcgactgcatttgtcaatatgaagacagtaaaccacgcattggtcttatcatcacctggaacagtcagtgcagctgcaaatgctacggtagcaacaagtgttgacacaagcatgccagattcggccattcctttggttttttccttaatttcttcagataacttcttgtgttccttataaaatacattaattggtctcatgcccgcgttgtttctcattgttcttagttcatcaggaacattccgcttcactacctatttacaaatcaagaggatatgtaaatgatggtgtccaaatgcataacttaattaatctttcaattatcacttaataactagagcaaattacaacaacacctactaagatttagagtaattacacaaatattttttgagatattagagtaagttttaaggggatgttagtgtaatattttcaaacatataagagatgttagtgtaatttttcaaatttaaaagaaattagtgtagaaaaataaaaaatggaattacatataatcatatgaaatctcaggaaaattattgtaatttcctcaaatagcttttacatattaaatttgtaagaaatacaatttcaaagttaagatatttaaaaaataaattttaggggtgatattcatttttacaaatgcacttgtataatttttaattaaaattttctattatatattggctttttaactattatgctaaagacaatggataacaaattttaaaaaattattacaataatcaacaaatactacatacaatgatttctaattttaattaaaacttgttacttttaaagatttaaaatcagtctagttaacataagcctaaaattagtggaattttaaatttttaaaataagatagctagaactgatcgatcccatgcgagtgaataaagaatggttgaataaagaaaactaagcaaattaattgaccttgaaccatgcgagctctgtttgcatttgaatgcttgctcttaaactggacaattcttcgaattcaccttgtggaagacgcgcaaccaagtgtagaatgttgttacctccatagtccactgctcgtcctagaagctctcttaattcccgtggtataatattatatattatttgttgtcgaaatagcacaaccaagtgcagtaggttccatccatttctgcggtccctataagtcactagtctaagattattgtcaagaagcatcttcacagcctcaacatctcctgattttattgcatattcacgtttctgttccagtttttcaacttgagtcaatacttctccaaatagccgatcgcaaacgtctgattccttggcaaacattattttgtgttattagaataactcaacaaacatcaaataccattattagactggatatagataattaaggactaattcttaattttttatataaaacaaaaatatatataactttctaaaatcaaaatcaaaatggaaatgatgtcaaataagatctaaattttagcttagaacacaaaaaaaaaaaaaaagaagccattttcaacttgtgaaaggttacctgacattcctctaggctcttcccccagcatcttcactgctgtaacgtcctcttcatttcttgcaatggccaaagcagttggatgtttttcaaataatcgccttgccgaatctgttatatgcacaaattaaatagtacaaggcaaggtaaataaaaactctaaataaattgaaaaaccacgtacgagttcatatatatctccttttatgtatatatatatatatatatatatatatatatatatatatgaaatcaatgagaatttagctaggacctgtttggttttaaaggatgatatcacagtctttcagaaacctaatagtcataatcaattatttcaactgattcaatgggttcgattcagtttgaaaaacttcataatatgtaaaagagaactagattacaaaaaggagaaataaggttgtttaattagttttacacttaccaaacatgtcgaacctaatggtcatcataaacagtcgttcaatatctttgaaatccattttgtctagcactttctgagaagacaaaatgtccaccagtctgttgtcaccacatttagcagccaagtgaactggaagcatcccatctgagtctggtattagcatgtcttctggcctcatacacttaaccaactctttcacaatttcatctctgccttcgcttactgctagatgaagagctgtgtctccacgtgagtttggtattagcataacttctggcctcatacggttaaccaactcatccacaattccaatcctgcctttgcttactgctagatgaagagctgtgtctccagttgagtttggtattagcatgtcttctggcctcatacgcttaaccaactctttcacaatttcatctctgccttcgcttactgctagatgaagagctgtgtctccacgtgagtttggtattagcataacttctggcctcatacggttaaccaactcatccacaattccaatcccgcctttgcttgctgctacatgaagagctgtgtctcctcttgagtttggtattagcatgtcttctggcctcatacgcttaaccaagtctttcacaattccacccttgccttcccttactgctagatgaagagctgtgtctccacttgagtttggtattagcatgtcttctggcctcatacggttaaccaactcatccataattccaatcctgcctttgcttgctgctacatgaagagctgtgtctccacttgagttttgtattagcatgtcttctggcctcatacgcttaaccaactctttcacaattccacccttgccttcccttactgctagatgaagagctgtgtctccattatcatctaacggaatgcataccatatcaggatattcatcaataaccgattttaatttgaaccactcatcataacaccatataagcatgcacagatgttcttttaaagaacctgcaatcctttcaaacttcacattataacatgtcctttatataataatcataacttttactatttagttgcaaagaagacccttttaatttcttgtttaccctaaatttgtaaagattctcttggaaacttgtctcaaattttgaattcttaatcatttcatcatttgtaaattgaaatctagctgagaaattcgagattatgtagtagtcgaagggatccaatcatcaatcacctttaactaagtttgaaaactgaatttcaattttgtgtttcaaaattaactctatgatgataagtaaaattgtttttgagagaagtaacttattttttcttttcttcagttgacaaaagctaagatcttaacatgctgcttatacatatttatactcatactttggcaaaaaaaaaattaaaatatagcaattttaataaaaaaattacgaaaatactgcaattttcaaactatttactattgtataacaattaatcacgtctggaccatacgtgttcaaacaagctccagccaggcgtgactgaagctcagtcatgccccagctaggcgtgactcaccaggtggtgacacgtgccattttaagacacgtgtcattttacggcgtgatatatataaactttggaaggtcataacttttgactagaatgtctaattaaggcgaaaccgatgccacgcgctcgaaattgaaagaagaagctctaaacaagtcccaaaaaggacttggtcaaattttttctaaaagatgtctctaagtatctcaaaattacgatttaatcttcgaaccttcaaaaaaattcttggtttctaatatttttatttatttaattagtgaattgcatgctattttttatttttctaattacttatcttaatttcgagtatttttacataaaatacgcctccatcggacatgattgtcatgaaggcctatttcgagtattttccaaaaattagcattaaatatcataaaatattattatgttttcatttatatgtattagtataagagcaaataatttatacacgaataatatgtaaaaaaaattatgatgtcactcatggtttcaaattgtagttatatttacagctacaatttcgtggtaattttttatattggagaaacttataaaaaatacatttcatgtcatgattgtgattaattataaagcttttatgttgcaaacataattatagttgtggacaacaatttaaagtcaattgtcattgaattataaatcaacacatataataagtttgatcatgtaaatttttttatattaacaatttacagaaatttaaattttaatattgagttaaaaataaaaagtttaaaatactcgaaattaagagaagtaattagaaaattactctaaattaatagaagtaattagaaaaataaaaaatagcatgcaattcactaattgaataaataaataattagaaaccaagaagggaatcgctttgattgcttgcaacagcttatcgatgctcgttagcgatgaagtccctcaaaccagaagtttcaaaagggcagagaaatgaactttacatactgatatcacataccgaagggaaggcctaattgtaccactccccctgaccttcagcctgaactgattgaagttggcttgagagttccgtgccaagcataaagattgaatcaataagactatattctaatcctagaaatgccataactctctttctgttctgaatgtctcgactttctttctcaaaaaaccggacaagggtgcgaaaatagcaagaataaattttttgaaggttcgaagattaaatcgtaattttgatatacttagagacatcttttggaaaaaaattgaccaagtctcctttgggacttgcttagagcttctcctctcaattttgagtgcgtggccaccaatttcgtctcaatcggacattccaatcaaaagttatgaccttccgaagttgatataaatcacgccgcaaaatgatacgtgtctcaaaatgacacgtgtcaccacctggtgagtcacgcctggctggggaatgactgagctctagtcatgtctggccgggacttgtttgaacacgtcttgtccagacgtgattgattactatacaatgataaataattttaaaactacgatatttttgtaatttttttattaaaattgctatattttaatttttttaccctcatactttaaaagtgattttacttttttttttatctttcgaataaaaaataattttctaaacccattgttgaaaaatcattcgtataataatagtatcaatatattatttttaacgtcaagcggtttcaaattcaatttttttttcaaattgtaaaataaacaaactcttaagacatgatctctgaaatgcaccctcttgtgaatgcaatagtttcaagcataacttactcagctcttctggagtcatttcattcactcctatactgccatgttttggtgacggtgagtttgttgaagtggcaattggagtttgctcatgactttgattggttgtatgatctggtgttggtataatctgaattatgtggtcatctgaaactccgatgttggagttcatgatttaattctagggaaaatgaagtgaattggatatctatatgaaattccctgttcgatcagtgttgcttctttctttccagcctgcgaagcttgaacatattatatatggtggtaaaacaagagcccttaattagttttccaacttgcacttaaaataattattccaaatatgacattttgtggattacagcaatgttccatttttagacgacttattggtagactttatagtggtacgtaagattaaaaaaaaaatcatttttttttctttagtgataaatctcattttgaaatcttaggagaaaagagaggataagaaattattcttttttttaatattatacagatctttagaattcttctataaaaactcattctctatatttagatatttgttcatctcttttattgggagatatagtgaagatcagatctcgagttcaagatccttgctaaagatctagcactagaaatacttacatctttagtggtagatttcaaattgagttcttataccactttttaatagaccctataatgtcaagtataattgaatatttctttcatttttttcttaatagtagatctcattttaagatatatttaatattaaatcttgaataaaaatcttgagttcaagatctaatattcactatatcttttaataaagaatgtgaagagatctctaacataaaaaataagttcttgtaaaagaatccttaagatctacacattattaaaaaaaaaaattcttctttctcactccctaaatctcaattaaaaatcttctataaaagatcttattgttgacgaaaactttctgccatagctgtggttatatatttatctaccttccgttgacgcatttaattctttgaatatatcccaaaactggtggtctttttatactagttatagtcaactacgccaacaaccattgaattacaagatgcatcggaaaatgtatgaattttattaaaccactaataacaatcatcgaattcacagcaagactagaaaaaatacttatttaatattttggtgaaatctattcaataatttattcagtcagtcatattaataattattttttgacattttaatattttatgttatgttacataaattctttcattaataataataaacataaattaataaataaatagatttatcatatttttttagtttcaaaaattttaatttatataatcatatttgaaaaatgaatttatcaataatctatatatttaaagataaaaataattatttatctaaaagcatctttagtgttggattttagaagagatcttctgttgaaaatctctcatttcctagatccatcactaaagagaaatgcagatctccacgtggagatctgattctttttcaagaatcctgaatatatgtacggagttcaaaaaaatgtttttttatgttgtaacagaccacaaaatgaatgggaaataacaactcacaactcaacgaaccattatagaagagaaaatggaaaaaagaagaggaacaaaacatacctatggggaagcggaggagaactccgtgaaagggagggggaagaagagagaataaaaaggggggagggggagtgtctagtgggggggaagggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttaaaattaatgttttgaaatttttttattatcaattttatatatttttcatttaattatcttttagttataaataaaaattatttaaattttatcatttcttaatatcaatatatttttctatattttattaattaaaattaattatttaattaaataaatttaacttaatcaaaatttaaatatttaaaaataaaattcatataatagttattaaaaattatctaaaataattaaagaaaaaaatcttccattttgagtgtcatccattataaaggttaaaaagatggtctgacacatttttataaaggttaaaaagaggccgtctatacgggagagtgtaatggatctcttatcatgaaaaagtgttttatgatagattaccttgtttaaaaatcaatgaccacaaaattttcttcttttagtattgtcttttcttttttgtcgtcctctttcctgtactagcttttcttttttgtcgtcctctttcttctcttctttcccattattcctctcttcgtcttagcggcaacggtggtgccatgacggtcgatgatagtggggatgttgatgcgtcgttgccttgtggttgtgcggagtaaactagagagaactctcgagagggtctttcgccgtttttcttgcggtgttctgcaacaagatttcgaccggataaaaagaatggaagacgaaacagtcacaaagctttatataactattgcctcacttaaaccaaaattggattcaattgaccagattttagtctcccaaagttttgagctttttgatatttgttgtgtacgtgttgattttttctcatgggtgccaagttacgagtttgtttcttgcataaacattgtttctattccattttactctcaattttgagtccaatttgggagaataaaagacctaagattttggttttgaaaatcagatgacatttttttatgaggatttgtgattatatttgaaattgcagtttcaaggaaattattgtaccattgatctgtaatatttgtaatatagccttgttttctgtgttcagatatgtgatgggtggtggtgcatggtggtggctccgctgccgtagtgaccatctgtgtatgtggtaaagggaaaaaggaggaaagggaggggctgctgaaaattgctttctgcgtaggtgtctttgtcgaagacaagaaaaaaggaagaagaaaggcgaaaaaaatgaaatgctgccgccagaggtgatttttggcaacggcgcatagtggttagagggataaatcaggtaagaagaaaaggaaaaaaataataaagaaaatagaagaaaaaaaattaatccatgggattaaaatttgataaatccaatggtgaaaattcactttaccgtcatgtgagttacactctcccacgctattatgtgtcagattagagattaaattgtacattaagactaaaaataatattcaaagaaagtacatagtctaaacatatattttatccaaaatatttcaaatctttttgaattagttgtttgatattttacaccgtgtttcatactaaattatccgatttgcaagatgtaactatatataagatttaagatttaggatttaaatcaaggataataagaaccctaaatcctaaattataaatcacatggaaagaaaaagactttgacatggtgtatgtgtagtttacgaaaaagataatatggattaattatagtgtgtttgaattttggctttaaaattatgcatgaacataatgacatgagtcaaacttgattttatctaaaactagttaaatggttcatgacttgcatagtagtaattttacaatttataatttcttataatattataaccttttaagataacatttattattattattattattattattattattattattatttatgacaatttaataaaaccatgataataaaaattaccataattattacaaatcatattagtgttaattaaattataatccatattatctcatgtatcaatttcttttactataaaaatatccctaattaaataagagagaaatcatattaacatatgtatttagtatagtatttttgaaaacatattattttagaacaaatttattattatcaacataattaattgttttttaaatcttgatgaattagataattgagtctaataaataggcatggaggtagtatataatatagtagatataatagatagtagatttagcatgtttagttattttagtagaatcaaatttacttgaaaaaaattatgatggagttgaagtaggaataataactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactaactgctatcaaaagaagttaaataaaaaaataaagaaatcttataatcttatttgaaatattgaatatttgctgagatgttaacgtaagatatataaaaggtgttgaaccacattaagttaatatctttaatatttctaattgtgatattgtttatatatatgtttttatcatgtgaactcacgaaaagaaacatgctcagaaaagatagggtgtcatccaatacggatatggataaaactatttgtgatttaaggttgtaccatatagaaatttcatacccgaatttctattgacagttacaacatatgattagtgatgtgtcttattaaattggatgatgcattcctgtttttatcactttattataaaaaaatccaatatagatctaaattcctctgtggatattaatgaaaaaacaggtccttgactatttgggcaagtcctcgcgagggaaccttatttgttgaagcatgtattacatttttgtttgcttggaactataataacatatccgtagagagagtctcacaattgatttttaaagcggcatggcttcacgacaggttcactccattgctcaaagttggattagtgctacagttatgagggaaagccttaaaataaaggggtaagttacttgataggcatagggatagacgatttttggttctttaaaatataaataataaaacaaaataaaaacttataaaacctgaataataaccggtaaacaagtaactattttaaaaaataaaatgagatgaaccgatgaaagatactggtgaagaaaagagtgtgtttgagaatgtgactctaatattcttccttattttattgtagatgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttcatcttgtccttaaaaactaaacaaaggaacatttttttgcatcacttagtgcatcaattggaaacatttagctatttacgcgtaaatacagaataatcaatacgtaatattattagtactcgttcatattgaaataggatgccaaatttgtactgtcctacaccgtctgtaccattatatatagtagctgcatttattccatacaataaatacatataacatatttaatactaccttcgagtttttttattctcttacattacccttcgaaggaataatgcaatacatacatatacatatatatactttaactttcaccttgcgaccatttataatcttctgtaacctgaaaaaaaaaacgtgaaagacaagacatattaaacaatcccaacagacaacaacactgtgaatatgaatgcccagaatatttggtcatggtagtttagtaaattaaaggataaaatatcttttcagtccatatatatattttttaataaaacttgattttagttctcaaattttagttttaattaatttaattctcgaattttaaaaaaagacaataatttgttcctcctcagaataaaagtaatgatgaaaccataattatttttctaaggtttaaagattaatttgatcaaaatagaaatatggaaactaatactatacaaataaatatttatcgagaggacagagattaaaagtatgccttattaaggctagaccgacaccgaaagaggattaacactgatgggcttgaattcgaggacctccttggagttcaaccatgacctaacccacactttcgtttcatacacatttttggtttcaccatgttttgcttcctaagtgatgtagtatatgaacccttccaccacctgctgctttgcactaatcaccctcacaaactccagatttgcattctgcatttccaactccaatataatcaccacaagtataaaaatagagataaattaaattaaacatgcatatattaagatgttaattaattcttaagttgtaaagttgaaacttaaaaggaagaaaattaaagaaagaacctctttattgttgtattggtcaacagcaaaacgagcgagattctcgatctcgacgctgttggcagctccaggcacatcggtgatgccacctgttactggctcttttgtttctgttgccatttctcttttctttatcttctctacatcactaatattctacggctttttatagggaaatatcaatgtttgtcttatctcattctgattgaatttgagtggtaaacaaaaaaagatcaagagatcgaatgaaagatgaaagatttttattttatcttatgcaaatattgtttttgaggtaattatatgtcatgcattaaacgtggattcttattctaataagaatttgaactattattcgatccaatgttgtaaaagaatagtccattccattttacctaaatctaatatatatgaaaaatgttagtaatacattttaaatatgatttttttcctattgattgaaattcttttaaatttcaaaattttgtaaatcttaattacatcttatttaatgaatttatttatgattttggagcatttaataaattctaataataataataattaataattattattttgacatgaatatgttaaaaaactgttatgctagccttgatctccgctactgagtgtgtatatttaattactatttataacaattattcatgtacgttttttatgttttttattttaaaaaaaagcattttttttaactattgcatttgcatatgtgtgaccaatctcagatattccctttgtcaatatttaacaaaaagcatttttttttttaactattgcatttgcatttttttaacaaaaatttcatattctccgtacgtcgttttgtcgtgggtgtttcaatgaattactgcagaagaataagcgggagacaactaattaacttcaaccttgacatttttggatacttgtggacacaactcacccatgatttaagcacgtgtttggatgtgaagtgtgaactacgatattatgtctccattatgagttggttgtgaaactgtgaaagctggtacactatgtttggcagagatataatagatagaagaaacaagaaaatgaggatgatatggaataaaaaattaatgatggagtatatttgataaaagagaaataggtgaagagagaattaaaaagatatatatgaaattaacgatgactagaaatcgatagtaacttctccccctctctaatttgtatttctcttaaataaaatttatatttttcacttagttttcacctatttttcttttctcaatttttatcaactgtatttctctttaaaatttatctgtttctttcgtaaagatccggatgtatcctatttttatttttcttaaattaaatgtttttatttttacttagttttcacctatttttatttattatatttttcttctctccatttttatcaactgtatttctcatttcatgtatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccgattaaaaataataataaactgcaaaaaaaaaattacatattttctattgatctttggtttggtttttacatctaattgttgaaattgaacctaactgcacagttaatatgcttatattcataatacagaagtattttaaagttttgttcataatatttcttttgataggcacttttgttcataatagtatttgtagtgaacggtatcatcattcaaattaatttagatagtataatcaaattaaattaattttgaaaattagataatcaaattgaacccaaaaataataagaggattaaattaaactaattttaaaaattagaaaatcaaattaaatttaaagaattagagaaccaaataaaaagttaaaattaaattagtgacaaaaataattgaacctttttatttatttattgacaaatggtaacgcatttaattttaacaaataaaaattgataaatatttaggaccctgtccaaatccaaggagggcaagtacttcatgattgtgacctcataatcgcattgagtacagaaggcaccgcaccaccagatcattctgctataaagttcgaatcatcaccatccacacattggacgaaacacgcatgaattaatacataatcaattattttattaatttcgatggaaatatttatctgtagtaatttatactgaaataggatggcaaacatggacaaccccacaccgtttgtagagttaatagctacatttattcagttcatacatattatcactcttgcgcccaagctagagttacataatcttccttaacctgaaaaaaacaccaaaggcgcatttaataatccaaacagacaagaaatctaggcatgtgaagaccataatatttgaaatcaagaaatccatttttgtaatgtgaaatcgatcaaatactcattataatttttttatttagtcccttagtttcaaaaaaataaaaaaacatagacacatagtctatgcaaaattattttttcatagtctttaatttctaccattctatgattcgatcattaacttttcgtttgttttgtacggcaagtgtcatttttcttttcttttttatttgattcctttaaatatcaccagttttttctttctttctttcatggtaaaatatatacctagctatgtgctagaccgtcacggaacgaggattagcagcaacagtgatgggcttgaattcctgaacctccttgaagttcaaccatggtttctccaacaccttagtttcataaacctttttcgtcacaccatcatttgcctccaaagtgatatagtacaaggtgccagaaaccacttgtttctttgcactaatcaccctcacaaactccagaactgcattctgcgtttccatgcatattcaattaaatcataagaaattaaaaacaaaatagaaaactgaaataaaaacaaaaatatataaaactcagatatgtgcttttataaatgctattgtctaatcagaatttttattttaatacatcacataataaagttttgtattaaaaaatggcatgagttagtaagataaaatttcaatttataactaaaaaatactgctcaaaatatataaaaatgaattaaatttcattttttatacagatatggttataattatttgactagtttctctcgagaaagataaaataattcaaaggtcagatactcccttccaaagacaatttattttccatttaagatttaaatctctaattagttagttataatggaccaagtttaattcttacttatttgtgagacccctaatcataatcagaacaggattcaggaagtcaagtatcagagctacagaaagaaactaaacccactttggattctcaaatcacgtgatcatggaatgatccagtacaccaaattaacataaatcataatatcttaattaagtggtaactaaaagttgacttaaatgaagaaaagaaaaaataaaaataaaaagaacctcttttttgttgtgttcatcaacagcaaagcgagcgagattttcgatatcgatgctgttctgtgctccagcgatgtcggtaaagccacccagtgctgccatttatttctgtttttcttttgatctttctgtcttatgtttatctcttcccttctatgacttttttatatcgttgtggaagagtggtttttgattagttaaatgtggctgtgaaaatagagcctatgcgtgtcggattttcatttgttttttattattgcaaacgtgtcacgtgtgaccaattcaattctctccttatgtttttgtgcatgatccacgacttcaaagttcaaccttaattaatagttattaattaaattcttttcatatttatattgggaaaaaaaaataagaatagagattcacactcagaagccaacctttatctccaaatgagtctgtacgacagaaaatgtagtagtgctgcatatatatatgtaagtaggaaacaagcaattatacatgaacaactttaaccctgtaacttgttatgcaacaattacttgttttcaagcaatttcatctaaaagtactctcaagtctcaaccaacaaattagtcaaccagaaacggtgacatcagtgcttgaagttcctagtggcttgtgaatgaaagtacctagcttgcttgctgtatggtttgatgaaaatttcatttgaacgaactataagtaatcagcaatggcacatactttggaatttctagctgaaaacctggaaactgcttgaagacgattctgatatgtatcgaagcaaattgagaagcacactaaaattaagcaatattgaaagcctaaaaaacgtgtcagaacctgaagaagttcagacaatgttccaggtagaaaaccggcatggatcaattatttttcagttaaaaactcaaatgaacttcttatcagttaacaaacttcaacatatagtgatcattatttttcgccaaagtgatcaatgagacaagacacatgtcacttatgaagctaaaaagaagtgaaaccaaaaacttggtaaggtaaaaataaaaataaaaaagtgatggttcaagagctaggctcatcaggctatatggactggtctaggaaccaggagacctgtgccttcgctcaagtcccatagctcaactctcaacttggagcgggcaggccagcataatgcagccaccaacccagcctggctaagccagagccttgtcccaccaccttgacgcccccacttgggtcacaagctgacgctacgcagttgtcagaagatttataaaggcttggttgcctaatattctaaccaatgtgggacttatatggttagtctaatttggaatgtgggacttgattggattctctctaggctctagcaattttatccgtgttgtgttataacactaaccccaaaatattgctgtagaatgcaatggtttccacttacgtgtaaataatctttctctattaattgtgtgacacagtgacttgtgtccactagaaagtgaagagaaaaacatagaggtgcatcctacaaattcgaattgaattaactgattatgataatagttgagttggattgatcggtgggttcaggtattcctaagatcccaattaacttaaaagtaactactaattgatagtcattcattattttaaatgaacgcaacaaaaattttcgttgcttttataatgaacatgaacaagttattactaattgataattatttaataaattacaattccttattcgagtcacttcaaacataaaaattcaaactaacaactatgtaaaaattaacgtgagtaggcataggatgatgggagtttattcacccttgaagactgaatcagtgattcgggcactgcataacatgaaaaggagcaaagaagttgcaatacaccatgtatactatttaaggtgaggtgaatgacacagctctttagatgcttacaagttctagtctctaagtatgctttagatgttgccttaatacttttgacgaccaaactagtttcattttcctacaatgatgctatgatttaagtcatgttactttatggaatataaggctgaggacatctttattctatatgatagtgaatttgtgagaaattgtctttagtatttaagagttcctttagtagagtgaaaagaataaaatgaaagtaaattaagatgaaaattttgaattaaaacatataagtgtgtatcccatcttattgtttatttctttttctttttactttctttctcatctcattgtttatttattttccttttcactgtttttttcttttcttttcaaacgaacgaatctttagagagaaaaaacaatgggggtggagggatgagagggagggcaaaggagttggggtgggattaagtgaagagggtggttatgtgacaacaaacaatccatgtaaatgccataagttttgaattagataattaggttttaatttgaaaagagtttaattcttctagtataagaaaactttataattaaatatataatttagtcttatacgaattgtggaatttcaatgtgatttttatacataaaaatggattaaattcaaatatatttttaatttcttaaatttaataatacatttgacggagatgaccaaactaataatacttgcaatataaagattgatttattaaacgaaatttatatagagactaaattgagattacggcacataagaactaaattatgtatttgacctaaattctgtatttgatggtgtatatgctaacaattattctaaaaaattacaaaaaaaaaatcaaagacaaaaaatctgaacatattttaattttttattaatttttaaatactaaatattataaattcaaataataataaccaacatttttttttctttgcaaagaaaaaactgaaaattaatcttaaatatgtttatggttattatgctaatggtcacatagtctgatagtcatatgaaaaataataaaataattaaaataaaacaattaaaaaataaaaataaaaaaacctagaaagaacacgatcaatcggcattcaaaaagtctctctgactcttggcagcgcgaagccaggagcagcgtttctcatggcggttccaccatcggaaaccgaatccgtagagaacagaacactcctttcacagttttactctcactatctcggaaaccgaatccaggctctctatccctacttctccacaaatttcttctccaacttcgctctccgcttcagatcaacgcagcgtcgggaatgtctccctcttccactaccttcctcttcactcgactctcccgtgtaagttcattctcctttttcacttcctcaaattcaacgataaataaaataaacaaatgttcgtgtttgaatatcatttgtgattttatgattctaagctctgtttcttttgctacattgaacgaacgtatggatgaatattagggtttttgtgctgtgttcccttgtaggctcatgaccaagagatctagagtgcattatgttgtggaggatatattagagcgtgttttgataaatttgcacggcgtccaaaagaatctgcacttttggcagtccagagctaaggttctgtttttgcttttgttatctgtatatatgactttgtttggataaacttctctataagcactgaaaagaaagaaaataagaagaaaaatggaaatgagcttatgcgttagttaaaaataagcttcttggagaagctaatatatgagaaaagttttataaattagcttatgcagaagctaatttttgctcatggagaaacttgtttcgtttttacttcttattttcttttcttataagtatttatggaaaaaattatccaaacaggtagttcacactgtgtctgttcgggaaatagtcatactgcttatttgtttatcattcagaggtcggattccgagaaggcacgtttcatgatatttgagaggggtccaaaggcttttattgatgaaacagttaagttgttgtgtgggctcattgctcagggttcgtccacacagaatctgagccaatctgcatctgattatatcggcgagagagtaggctttttgggtagcttaagatattcactcgccacatttttggctcaggtatgctgtgttcaagttggctttttccttgtgtttgaatcacgactagtctttcataattagaatgaatataatttgcttgtctgttgttgtcaagcttactcaatagttaataatcctttgaattgtatgattccgtcacattgatgttattaatcttcatatttgtagaagagaaaaaatttggaatgaccaaatgattatgaaggtggtgttgtatcttgcatgttttcttagcagctgctgcttttcacccagttgacctagtttttctcttgggtactttcccattttttttttcttgctgtggcaccattattgatgtctttaggggaattccttgtatgggccttcagagggattatgaggataggtttgacaggatagttcagtcagcatagaatttaagctaagttatttacatgtagatgtggggttcaagttcatctggcatatcatatgattctgtaagtgtagacaaatattcatggtgaacagatgtaatgtacacttatgaactcacctgtagacatagaaaattataaatatgcaagactttctattcaacttaactttcttaagtgccaatgacatcaattttctgatattatttcaaatttgaaacttcttactcaggtttatatggaagttgataaaattggagaggagttagtgaaagatccagagactaagctgcccttgttgttggttacaattaatgttttgttttcaacattagaagcttcaattggacatctacatgcaatgcgtcaggtttatataaataaagttgtttgtttttgcctctgttttcccttatgtatactcttaccccttatctctatgtaccatggtttgtaaagcaaaactgaagcatgtttgcagcttaatattgtttctagaattgaccttttctatttattcagagtgattcttctgttgatgggagctattcaacccctctgctgtttgagaagttgccagaaataaatcaggcggggtctcagtggacagactgtgaaataagagatgctatcaattcagtttatcaaaatttagacaagttggattcatacatatcttttcttgtaagagcttctatattatgttatttgattaagttttggagactgtcactgtctaaatttttacctatatcatatggtctaatattcatgatatagcttctatattatgttattttcactgtcactgtctctatctcctgccaatctctgggactttgtcaatgcctattagaagtggacaaaattatcttgactggagtcaataacttgggcttctattttttgaccatatatattggatttagtcatttgtggatggaggttctgaaattgaacaattaatcaacttgttttaataatacatatttgtttctagttgtccagcttatgttgattggtttgttaagtaatatcattaaaattttaagtttcaattttatggttgtaatatgtttcaggtcatcaaacataaaaagccaaggaaaataactcaatattggatccgctatacatgtggtgcagttggtttgtcagtatgctccatttggctcttgcggcatagtagattggtggggagttctgatcttgataattgggttgaggaagctaggaactcaacatatagcttttttaagaatcacgtagaggaaccggtacatttcttcttgataatttactatggtttcactcttttttctttttttttttcccctcctcaatataggagaaattaacttaacatatccttatgagataggtgtgatcagcattattcaattttcttaacctcatttcccttaaatctcgatctataataattagaattaactatgtacccttcgtaaaagtctgttctccatgagcaatgaagaaatttcattttcttctatcttctccctcttcattcccatttttaaatctgttgaaagtgaaccaaactgattaaggtttacaaattgatgtaggatggaagcatgaaataaggtttaatattgtctagaagctgatctaaagtgcaatatgcctctatgtaatatgtatataaggttggattcccccagaaaaaaaaggaaagttcttagaatgtattataaagctaggaagagtgttgtttgttgttttaaaattaagcctagcccttaaattattctattctattcaatatcccactagtactcgtttgactgggttaaatccatcagttgaaacttgaaaccaaataaaaccctttaaagtaatctctataaaaattacataaaaatcttatgtactattgagatatgagtcctcttgcttgtcactttgtcctgcgtcataattgtacttttgtaagtattctgatgcaatcatttttcagattttgtccattagggatgaactttttgatacattcaagaagagacatcaaggtattatggacgttgaagaggtgcagttaacttccaactcactacacaggttattggtttttacatacgttgtccgcctttttttatttttgaatactaaacctgaatgaaccttaatgctcagaatgtttaattttttttatcattacaaaatgtttaatttaacataactatttacagttttgcaatatatgctgttaattaggcaccttaataattgcttgtgaaacttttgggacttgaaaattttagtgagttgtgttgactctcttccatggcttgaattgaagctgattctgtacgtagaagatctaatttgaaaagaaataggaaaaaaaatcaactaatagaagctgtgcggtaaatgcaggatgttaatttttctaatcctgttgattcagtgtagtctggttacctactattatcttttacaatgttttctagcatatgctaataccataagtagaagtacaatccagtaccacctaaatctgtctgaagaatttggatttattagcaacaagataaaatattaaaatatgcttagcagttagcagtaaggatatattagagatatctagtcttcatactatgaattatttcattttttttatgactacctgtaattgcatttactcatattcatggatattgctttaagcttgattgacgatactcatctacttgaaattgaaaggcatgcttgttgcatggataattggatattgctttcgttgtaactttttctaaaaatttctgtacagaatgttgttggctttcagtgagcagacaaagggtcagaagttcccagtgaatgcttcagatcaggaaatgatggagatagtcatggataggtgagtttggatatttcactttagaaccatctctagttatacttgtcttatggtagtaactagtaaggtacttatggaattgaatttgaaatagatacatggatttgcttgtgagccattttccttcatattatacctgtagggttcattatatgttggtaatagcttggttgttttctggatttagtactaaaatagttctcaatgccaatgacttctggggaatgaagacaatgctctatagaatttctagctattcttctcgctttgatgtttcatcatgaagatgtgttatttttaatagaaagccattggtttgatattgacattaaatgagtgtactgctgtatcttttgactaaggggtttctggcctatgttgtgggttaactattctagtttaactagcggtatcttttggggttggaaatatgtgagcatttatagtcaaataattttaagataatgggtttttcattttttaagttgcccttctgatattggatgtccatgttagaacaatctaaattccttacctggatattcatataaaatattttcaatttacattgattgacaatattcaaaactttacagaattaaaaattggattttgatggaacaaaaggacaataacatacagaaagtgttttttatatatattagtcctctctatattatctgatagggacttgggtattatggggtgcctatgtcccacattgagtagtatggatgcttggtggagtactttaagtgacttggcctccaccccccactgtaagggggttctccaagtgcttgggtgcttatcaattggtattaaagctggctgtcaactcgagaagggctatctacgaggacttcggctctcgagggcagtgctaagataaggacttgggtattatgtggtgcctaagtctcacattgagtagtatgggatgtttggtgtagtacacatgtggcttggttctccctccttgactgctagcttttaagagacggttccccaagtgcttaggggcttatcattttctaatatcaagaattattgaatttagaatctttattagtaaaattcataatatcacttcatttcttgtaattttagtgtttatcacaattgttaagatctaattttttcaagtataaatgcaggtatgagaaggaactcatgcatcctattcaaaaccttctcaatggagagctggttcgggctatacttattcaggtaatataattcatatgttatatcttatatgtaacatctggtttagtagttttaacgtaacttttcactgttccaggttcagaagctcaagctagacactgagacgtgagtttttttaatctgaaaatttaagtaaatatttcacattgttttaattcctcaagataatattttggtcagggcaatgctagagctgaaccagattctacgggcaaatgaaatcaactttgcagttctgactgctttacctgcatttttcctctctcttttactcatgatgttagtgcgtggatggttcaaacaggtaatttcccttggttggttggcacaaaatgatgagcttaaagaagatagtactccaaatatcatactatagtattgaactcttgagaaaaactatatcaactgagttggagtgtgaatcttgtttgaagtgacaccctactccatgaagtgattaagtgaatattggtgacaagattgttgggaaagaaaagagaggggggggttttggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgcaagttacagtatgtatatattgctaaatcttaatctcttcactcctgactaatttttagtgtatgtgtagggatactgttaaaatttgtttatatgtgatagtggactagatattacatcacctgtttctagttacttatgtcttaactattatttgttaggtaaaaagatgttttttgataccaaatctgctcaatttcatcctttatttctttgtccactaatgttatacttgactgttatcattttttttgtatagaattttgttatttgcctcgtattgattggtggatgctacacagtgttatgaagttacctattctgttttcaatggatttggttactcattatagtttagtgagataatttccaatgattttctaaagtaagttggcttggatttagcatggacagaacttagatacaattccttaggtgttgtttgtgatattctccaattagaattggagttttaccacggtaaattgtttctttttttttgtcaacttgtatcagtaccactacttacattgataaaaaaaaaaaaatctgtgtaaattaggataccaaagctgagggaagaggtagagttgctcggattcagaggaggctacttgttatagaggttaagaaaaggattatgcagtaccaaaattatgttgatcaagggttggtaagtagctttcctttttgttgattttatttagttgatttgaatgagatagatagaccaaggatagaaatgtcgtgttacatgttatctacaggagagagatgcacaatatatgtttggattggcactctatagcctggatcgcctgtatcagtctgtcaagtggcacgcagaagctaccggagagtgggaacggttagttgcactcttctctctcaattctcagctacaattgtctagttactttctgtttaacaggctcatatttatatcctcttactgtttaagcacatgaaaagaatgtgatttttttgaatgttgagattgctaaatcagtgtaattatgaacagtttgcgtgaggatataatagatttggctaagcctagactacaaactgcacacaaggaatctgtgatatcacacatggttacatttgactgcttgcttccaagtcggaaccgccagtagcatcttttagcttactattcttaattcttttcaatgatgtttctcttgctactttgaaatccaattttgttgcgaatgtatacatatattcctcgtacatggttacattttatcatcatattatgataacttttgacaattttatcaattgaatacaaatgatttatgaagggataatatatcttcatttgctcgcaaaagtaacttaggattaaaggtaatgttgatgttgatcttcttgctcatgaaagtaagtactctagataacattctcatctccgtttttggctactagtgcaagtctctggttattttttgattggtgttcaatccttttccgtcacaactcagggaaggcagaattgaacatttgtttttttttttttttttttttttttttgggcgggggatgattaaaattcatcagacaaagttatatattagtattacttttatacaaaatattaataatgttaggtcatgtggttatcagttcatcagttatattgttatttgatatagtagagactaaaaactgttaacaaaatattacataagaacaaaaaatgttaaaaatttaatatgaaaattaacgatagaagaaagaatgtttgcttgtttcataattcaagttatcaattgataatcatttaatcacaaatgtaataactagcaaattttagaatagaaataaaggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaaaaattattaaatgatactcaaataaaaaaaaagaaaaatgtaatatcttcacaataaaatttataaaaaaaggaaataaaatatttgtattaaaaaataacgtttttttctttacaacaaaaacatataaagataattgattattttaaaaattaaataaaaacaaaaacatttaaatatcattatttttaattaaattttaaaaatagtatctaaaatttaaaataacatgtatattataaaaaaaaactaaaaaaaattaacctacaagtaacctcattagattatttataacgtattttttgtgccttttgtggagctataagtgtatgcaacaaattgtgtttagagttggacaacaattgaatatgatgcttgcccgtatcttgtccatgtcttttcacagtcttctgatcaaatcacgtgcgtgactgtatctttccatacaagcttaaagcaattaagaaagaaatttaaagaaaactgctttaatttctaattacaatcgataccatacgtttctcgacaatttatttaaattactttcaaatatttactttttgattttcttatcccgacaagaaatgaaaaataaatttaaagggaccgatattaattaagaggcagatacaactacacgcacatatcagtaatgtaaaatattgtttgttgtgcatgcgattataacaaaagagaaaaactagaagaaaaaaattcctttgtcaaagaaaaaaagaagcctcaagtatctactgtttgtgacacaagactatcttttccctacgataaaaaaaaatagtgtcaataatttttggaactatctcttatttaaactgatgtgaactacaaagcgtggaaaattgagtgcgagaataattaaggtttcttttctattttaggagtgataagtttttagtctcaatttttttcagattttaattttcagtccttcaaatttttttggaaatttttaatccctctaattttattttttttcttattttaagttccttgtttatttttagtccctcatttattttatattagagactaattttacgtaataaaaataaatgagggattacaaatgaataaaaaatttacaaggattaaaagtgatgacaaaaaattaatggaagactaaaatttatcaaaaaaaaattaagggctaaaaattggaagctaaaaaccttcagggactaaaaatttaattaatccttaattttattgcacatctcgaagctaatttcttataagtagtttacaaatgcttcattaatataatattattaaatttaatgaataaaaaacaaaaatagttttaatgaaaaaggtaaatataattatattattaactaatcttttgtagtgtttgttttgcccctggaaggatgaaggagaggaagaggagaatggaaatgtaatgtttattaaggaatattgaacccctaagcgaatacttaaacacaaaacttccaatttaaaaacaataatagttgttcccccataaaccaagggtcaaaatcatctaacaagatgtttaacatgttcatcaagtatacatcttgcacctaaagattttaattcaaatttatttatatttatgtgtgctacattgttgatatcagaatatttcggttcaactatttttttctttaattttttaagaagctaagctcaatgagtgaattattcaatctaacatctttccaagagcgttgttaacaaaacttttgcatattaaaacggggttcaaaaggggtgttgctcagtgctcaccctctccagagttaacaccacctagtaataatagcattcaccacaaaagtttaaaagatagaattagtacagagatatatagaaattcatagaataactaagtagactgctttattttatttcttgcgggcaacatagataagatttattacttattataggaccagtctacatatagcaaccatattcaccaagaaacaaaatctcacgctactacttattgcccttgtgttcagcatgcagaccatcaaagtaaccctgaggatttttctcaaattccttcctcgaaatataagatccatctccacctggagccttcataaccttatcttcagaaccacttccaacattgtctttgggtttggggacttcacctttgctaacttcaccactagctttcctatccatgattcaaacttatcacaatagtagagatataatgcacaataaagcttaaaaaaggtttcaagttactattagctaggatatgactgaaagctagagctggctggctatttatacaaagaaaaatggtgaatttatttttcgtgaattgctgatattaaattcctttattcgtttccaaaacgtgcatttgattcatgcataagaccaagaaaaatattaaagcatgcatttgactgatgcttcaattttcaattatatttcacacctttcatgcgaccaattgttgttaattcttactattcttatgccatttatattcacctttttcacttcaaaactagtggtagctttgtaattatttagaaataaaataaataaagcatgcttatataaaaaaaatagtaaataaagcatgcattttcatttacttaagtgttaattgtcacttatatagtggtgagaagatttgggtattttaaagaaaaagattcgcatatttacaagttacaggtgaattaacattaattatatatttttttaattataattattatcaattgtgttatataattattaaatagtatatacagcatagaaaaacatagaaagacaactaattagtgttttcccctatattaagtgccctaataaaagaaagttgaagtttgaaaaaaaaatggtctggtagtagtattattcaaattaatgaaaaagtcccaattaatccattccgtggatgtaaataacattaacgagaagatgatttagatcaacggtataaccacaaccttcggctttaggtttgacatggcagttttacttacaattattgtatagttgttttaatatttcttgtttcgattacagatgaaacaagctatgaaaaaaccgttattagttatgatttgttatgacaatgttccaatattatgatgctaagaaattagtctgtcacaactgacaccaaatgtagctagccaccacaaaggagcaacatataaaaagactttgtgtcaatagcttcatttgtgattctgatttgctaataactattatcattcattgcattcgagctagctactgtatcttgatcaataacatccatcatggggacaaacgagaccctattgagcataagcagaacaattttcagtaatgctacgttcgacaactataattcagacccagacagaaaatttatttactataatatttccattgacatgccatccaagatagtatccgatggcatatggggtaacccaaattatggcgctttactttcaagatccacaataccggtgttggagcttcaaattctcaccattttcgttatcacgcaatgctttcattttgtgcttaggcgccttggcttcccttatttcgtttcacaaatgatggtacgtacatacatacatacatatatatatatatatatatatatatgctttgtcccttctccaatctttgttactgcatgcaggtctcatacaagaacatgacatattgcacatcatgttaattacacagaaaaacactattatctaatagcataggcatgcatgcatgacattgttatatatgttcttaaggaaaaccatataatatcaatccatattatatatatgtgaagtaataaacactcatttattttaaacactccatcaacacctctcatttctttatatttatttctttctaaaacatcataaattctattatatctatatttttttgtctgtctcacagtacaatagatgtccatgaaacaatttccatatagatataggattaaacttaggaataaataaattagataaacgttggggtagcatatataacaattttaagataaatatttatttaattccatagattcctgagatgaaacttcaattcattttacgtgtttaccgaaataaaattatttgtaaccaagtatgcaatatatatgtaaattaatttccaaatgaattggtgcatatgcaggctgggtttgttctaggcccttctctgaagatagaagcattgaccaaattcaaagtgatattgttcccttacgggagtgaagacgtattgaacctagtaacagggattgggtacttattcttcctgttcctaaatggggtgacgatggatttcagcatgataacaaaaactgggaagaaagcttggacaatcgctctttcgtcccttatgattcccactttcattggtctcttggtatgctacagtttcatggggtacttgcaacaagccctaggagagttcgatggaggaaaacttccggtgatagtaatagggcacagtggttgttccttccctgtggtagcttctctcctctctgatcttgagatattgaactctgaacttggacgcttagcactctcatcagcactttccatggatgtgataaccgaagttatgaggggatttggcgctgctgttgtgagtagccttaaactcgattctcacgataaaggtgaaggaaagggacctgaacttgcactcatcacatccataaaatatgttgttttcatgacacttacgattgtgattgcacgccccgcaatgaggtggattgtgaggactaccccagaaggaagacctgtgaagaaaacatatacatcatgttggagatatagagagataatggaaaatatttgaggaaaaactctttgtatttaaattgactaaacacaatacaacaatacactcaactttcaatctcacaatcactctctcaaattattttgtaatacaacaacaaaacacacacaaacttacttccactctaggtgcttcagcattcaacaaacaaacactctctttctattttttctctctacaaatctccactcttctctcttttctaattaagtgctactgcacttcctttcaatttttcctctctgctttttttctctcttttttttcttatattttttcaaatgaaactactcctatatatagctacaaaatgaggtgtgaaatggtgcaaaattcagccaacttttacggctcattttggtggctacaaaattcaatataggctgccactcttttcaacaattcacgtagctgccaacttttctttcatcacatgcattctaaaagcaagtcaaaaaggatggcttctagagagtttgaattctaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccacctttccttcttgattggtctttgtcttgtacacccactttacaccaatgggcttgtgacctttaggcatggttgtgagctcccatgtgtcattccttctgattgcagcaatttcatcattcatggctttcttccacttttcatcttctgctgcttcttcatacgtcactggatcacattcagccattaaacaaaataatgaataatcaagtgtagtctgtaccagatctgtagcatcatagatatcacttaagcttttcatctttgctggtgctccccttgaattgctgctgctgctattacttcctgatgttgatggtgtagctattggagttgttggaataggacttggtggaggagtttgatcatttcctccttcatctatttgctcctttgagtcatcatcctctttgaaaaataggccttccaccttcttttgttcatcactccatctccagtaatttgcttcatcaaactgtacatctcgtgaaatgatcgcctttttggttagaggattgtagagtctgtatgctttacttttgaggtcgtagccagtgaaaatgcatttctcccctttatcatctagcttctttctcctttgatctggaatgtgtgcatatgctatagaaccaaaaattcttagatggcttacttctggtttcttaccactccatgcttcatttggagtcttgtactgcacgctctttgttggacaccggtttagtagataggcagcacattgaactgcttcagcccaaaatgtttttggcagatgcttctcttttagcatactcctcgccatatcaagaattgtgcgattctttctttctgcaataccattttgttgtggagtgtaggcagctgtcaactgatgtattatcccatgttgcctgcaaaattcatcaaataatttggaagtatattcacctcctctatctgttctcaatgtcttcagatattgaccgctttgcttttctgccattgctttgaattccttgaatttgtcaagggcttgtgatttttctttgattatatacacccaggcttttctgctgaaatcatcaataaatgtgatatagtacctgtttcctccaagtgatggaatgtcaaatggacctgcaatatctgagtgaactagctgcaatggtcttctagctctccatgatttgcctacttcaaaactttgtctgtgctgctttcctttcatgcagctttcacacaattgatctggatgatttattagtggcaatccgctcaccatatttgcctttgacaacagcttcagtccagtgaatccaagatgaccaaatctgtggtgccacaaccacgaactatcctttgtaatggacttcatgcactttattgcttgcgtctggatattcagcttgaagaggcggtttcttgtcatatcaactttcgcaatcaactctcccttttgatttcttattacaagagagttatctttcaagtgtatatcatatcccttctccagaagctgaccaatactgagaagattgcttttcaaagatggaatgtaatagacatctgagatatatgccttacctccattttttttaaaaatcatgatttttcctttgcctttgactggaacctttgatagatctccaaaagagacttctccatgaacttcttcatttagctccgtgaataactcctttttaccgcacatgtgattgcttgctcctgtgtcaaggtaccagacatccttgctactatcttcatcacctttgtatgtgaacaacatggcttgtccatctgctttgtcgtcatttgtagtataatgacttctctccgcaactttagcagcatctctacattcatagctgagatgaccatatctattacaattataacactgcaagtgagatttatcacctctttgaaatcttcctcctcctcgagtcatgaaaccacgtcctcggccacgattaaatgatccttgaccacgtccatatgttgttggatcggtctgaaatcttctattcgcttgggcatatccaccacgtccacctcgagtgttgaatccacctcgggtgttatagcttcctctatatcctccatgatttcctctggcaggtacaaaactgctcctggcttggtttccgtcaagagacaacttagtctgcatagcttgctccatactgctagagcctttattcatcatcattctttgctcgtgagcttgaagagaacccacaagctcatcaatagacataactgtcaagtctttggcttcttcaatggcagtgacaatataatcaaatcttcttgttaatgagcgtaataccttctccattattctgacatcatctagagcttctccatttcttttcatctccttggccaccttctgcactcgtgaggcatagtctgtgactgcctctccactttgcatcttcaagttctcaaactcggctcttagtgactggagccgcacccttttggctttgtcagctccttggcaggatttctgcaagatctcccatgcttcactggatgattttgcttcagaaattttttcaaatgttgattcatcaacaccttgaaaaattaaaaatagggccttcttatccttcttacgtgattctttaagtgtccttctctgtgcatccgtcatggctgcttcagcggctgcatctgcaggctctgagtatccggtttcaacaagctcccaaacatcttgggaacccaggagtgtcttcatgtgagtactccagtttccataatttgactttgtcaactttggaatttgaggttgaaacatctctgtcatctttgatcaacctagctctgataccacttgttggagatatagagagataatggaaaatatttgaggaaaaactctttgtatttaaattgactaaacacaatacaacaatacactcaactttcaatctcacaatcactctctcaaattattttgtaatacaacaacaaaacacacacaaacttacttccactctaggtgcttcagcattcaacaaacaaacactctctttctattttttctctctacaaatctccactcttctctcttttctaattaagtgctactgcacttcctttcaatttttcctctctgctttttttctctcttttttttcttatattttttcaaatgaaactactcctatatatagctacaaaatgaggtgtgaaatggtgcaaaattcagccaacttttacggctcattttggtggctacaaaattcaatataggctgccactcttttcaacaattcacgtagctgccaacttttctttcatcacatgcattctaaaagcaagtcaaaaaggatggcttctagagagtttgaattctaacacatcaatggtgattctcatgaccatattcgtagggttgtttggagtttgggctaaccagacagtgttaggtgggattttactcgttggtcttcttgtgccagaaggtcctccattgggctctgaattggtgaagcagcttgagatgttcaactcatggttccttgttccaatctttgtcacgtgttgtgccatgaaggtcgatgtttccacgcctattagttcccagttggttctcgttgtggttaccattgttgttgttgtgcatttggttaagatgcttataactgttgggatttgccgctattgcaacatgcccaaaacggatggtttctgcctcgctctcttgttgagctgcaaaggtgtcgtcgactttgtcaacgacgtctttctctttgattcatttgtacgtaaactcccttcactctctttttattttcaactattttccttaatttttaaaaaatgcacgcatgttatatatttgtacaatcattataccataattaatactcattaaattaaccaatgatcaggtgatgccgattgttttgatctcgatgaatcttcacataacacattttcaaattactatatgtattatgtggaaattggccaagaccatgtattcttgaattgaacaagtaaatttttctttcttaggactaatatatatgacaaaaaataggtaaacaaaacatatttaaccagctataaaagttatctaattttagttctaatgcaatgcagttaatgagcaaagaaacaatctccatgatggctatatcagtgttggtgttgggaagcattgcacgcattggggtgaaatccttatacgacccagcaaggaaatacgcagggtatcagaaaaggaacatactgaacttgaaacccaattcagagcttcgggttgttgcatgcatccacaaaccaagccacataaatttcgtaaaaaatgttcttgacatttgttgccccacaacagcgaaccccttagtggttcacgtcttgcatctgatggagttagttggtagatcctctcccatcttcatctcacaccgtctccaagaaaggcttagctcaggccacaactactctgaagatatcattgtaacattcgacctctttgaacatgacaatgctggcactgcatcagttagcacctacacagccatatctccactacgtttcatgcatgatgatatttgttaccttgcattggacaaactcgcttccatcatcttacttccatttcacataagatggggtgaggatggcgctgttgaatcaactgatgaaaacatgagaactctcaactctaaggtccttgaaagagcaccatgctccgtggggattctcgtgaaccgatgctcttcttcttctactcatcacagccctttaatgaagcaaatagcaatgatctttttggggggtgcagatgatagagaggcactgtgcttggctaagagaaccatcaaagattgtgattgtaacttggttgtgtaccacttagtttctagccaaagtgaggcaaattggaacctcatgctcgatgatgaggtgttgaagagtgttaagggctattatggtactattgagaatgtgtcatacgaaaaggtttctattgagcaaccttctgagaccaatgcttttgtgtcggatattgcaaatcgtcatgtttttttcatagttgggagacgtaatgggatcaaatcgccacagacaacagcacttgaaagttggacagagttttttgagttgggtgtgattggagatttgcttgcttcctctgataccaatactaatgcttcaattctagttgtgcagcaacaacaaatgcccaagtcgtcgtgaccaaagagatacatatactgtaaccagaaacttaattactgattcttttcatagacaaaaggattttaatgttgtagctcaattttgtaagtatcagcaaaagaaaattttcatacaacacttctgtaaatttcttctgatctcagtcagtcctttcatgcatataacactttttaatagtgattgattggttttaatgggttagtattaattgggtttaaatatgtttttatgtaagtttagtgtttttacatttttttttattatcttgaaagtccatttttctaattataatacctatacgtttgcatctttttaatttttgttgtcgtaagtgcgaacttataaggattatatgtaacatttcgggtgcttgacgagaacagggagtgatcgtcggtgtaatgaggcacggacaaggagcggctcctgacaggcttccagcaggaggggtacatgaatgaatcgaatacatactcgaacgagaggggatccagaagctgtgcaggtatgagattatacagttgatgataacttaaaaggcctaggaaataatagatactacctataccaacaaggtgcatctatttttcggtagtccataacttaagaacttcacaattaagtgtgcttgacttggagcaattcttggatgggtgacctcctaggaagtttcttaagaagtgtgtaaatgaggacaaagtacgctgaaaagtcttgtattggtatgtggggatattaatttttattgtgaaatatgcatcaattttattgattattaatttttaattgaagaattcaacttatcacttttaataaatatgtcctcttaatcatatttttttcaagtcaaggctcgagttgatacttaagagatcctagccacaaaccaatgacatgtagagtttttatttttaaagaaaattataataaattaaatttaaaaaactaaataagagaatttatatttaattaaaaaattaattgagatggtgtgattattaaaaatagagtgatggtttttgtacaactcagtttttcatatacttcattggcaaacatttttaacggactctaaatgaccccattactaaaaattaagaatattttaattttcaaaaaattaaatgattattttaaaattaaaattatagtattaaaaatattgactattagtatattatataaattcctaacatgatatttataattaattaattttagaatatacatctataatatttatttatttatttatttattttgagactaattaaagtcaagaagtttttttattaaagactataatcaaaatccaaagatatttcagaggaaaaaaaacatatgtaaatctaaaagtcttaatgaattactgaacaacctcgtcctaatggtacaaattaagattcacgggtgtttatagaaaactaggaaaaagaaaataagaatagatcgggaaagcaatccaagtgtagattagtataatttgaaaacgtagcatttccaataaggaatcttttaaggagatcttaacattaagatgaataagatttattattggagtaagatgttggatttatgtatgaagatgtaatttttgtaaaagaattattaagatttgtatttatttatgctattcatattttatgtttatattatttgtgttggtcagcattatgttgcatataatattgtcgatcttacaactgttttataaaattttctttttagcttaagaaaaattttacgatcaaaattttaaaataagatctactattagaataaaaatatattctaaaaaaatgattcaagatctcaaaataagatctattattataataacaaataaaaaagatcttgagagtgatgtgatacattaaaatctacaaaaaaaatgttaaggtcccaaaatgaaatcttctataagagatactcaatcaatttagagtaaattcaaaataagcatccaaaaaagacatatatatgataaaaatctaattaaccagaacaacttcctaatcatgttgtttttactggaaatcatttaacttgtagccaattagtaaattcaacaaataacttataattatttataaatagaaataaaaagaaaaggagaaaaaagaaaaaaatggggagggatagatatacccaaaatatttttttaattaatatatagggtatatatgaagagaacaataaattatcattcatcgtctttgcacttccgatcaccaaattaaaacatcttatttactttgtttttctcaaacatcattcatgaaaccatatatcacactagattgccagaataccagtccatcacatcatcattaattaaactaaaatccaaaaccataacaacaaaacaaggaaataaaagcaggtccatagaaaatgcatattatagtcttcaagctccactggtagaaggatgagaagagcatccacaaatgaattgagtatgttcttcccttctgtaaaaactcctgtggcagccacatgcagcacaaatcagacctgcatcagtaccttcggatccgcttggtatgaactctgtgcagccatccacagcatgtccttcaagatgcacacatgattcctttagcgctcgcgatatctcacatgcctcacaattgtcactaatgcgttgttttggcatctttgaggcccatttcttcccatgagaaccatccttctcatggtatgctatcctccaaaccctgcaaagttgtcaaaattaactgttagtggataatcaaaattgtagccttgaaatcataaataaacagatagagagagagaaatagagagatgattaagagagaaaggcagtgagagagtacagtttattgtgtaaggggtatgaagagccctaaccctagaagttatatttaaattgactaagtccgagctgtgccaattttgaattgtaagtaaatgacaaaagaacatctcagaaccattcaatgtaatattttatttctttggacatggaaacggtagaattttatatttttcttatgtttttcattaaagccggaccagttagaggattgattcttaagttcgcttgtatgaaagaaagaaatatatagagaaagttaaccttttaaatagatgttaatatttcaagaaattagtttttacctatggtcagaaataccttggttgattaaaacatatttagtgatattttttttttcacatacacgaatttcaagatcaaactaatgaatatttttaaagaatttaaataaatttcatttggacccacacagtttaataaatggtaaaaaaaattaccatttattaattttacaattacttcatctattttttgttggtttccaaatttttaaaaggtaaaaaaaatcaaatatatataatgaaaagataaattaagttttcaacattcatcggataaatgtaagagttattgaatcaaataattaattataagattttaactttatataaaatggtagttgatttatgattttctattgaaattttttatataatttttttatataatcatcttcaagtgaaatctattcttctaattacattgttttggaacttgaacatgaaatcttgtttaaaaaattagagttttacttcattcaaaccaacaatcacatgttcatcttaccttgaatatttttagtttttaggttaatcaataacgctaatgtatgtttttattcaaagttacaacatatatatttaaactaaggtaattaacaatattcatgatttaaacattcaatcattcaattttattaaatatttaatttaattaagctaattataactaatatatattttgattcaaattaattgataacattaacatatattttgactcaaagttacaacatattgaattaaggtattaacaatatttttatttgaacattcctcatacaatttaacactcaatcatttttttaatatttattattatcaatgctttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggaaagaccttgcgagaattttcttctattgttgtgtgttctgatttcgatttcattgtatttgataattattttgatagatttagtttataagtggtatttttttagaggttaaaaagtaatgattttgacaaaattttagacagtgaattttaatgaaagatcgaaaagggaaaaacttgtatacaagaccaaaaaagagttacttaagatgacatgaaaaacatattttcaaactcataaatttcatacatatcacactagatttgaagaacatcaccagtccattacatcatatcattaagcgaaaataaaaaaccataaatttaaactaaacaagcaaattaaagcagatccacagaaaacatataacataggatagatttagatatgatgaagaagaattgttcagcaaacacatagaacacatgatcgaaagtcttcaaagtcaaccagtactggtagtagggtgagaagagcaggtacaaaccacttgagtttgctcttccttcctgtggaagtttctatggcatccacatgtagcacaactcatagctccgccggtcccttcggcgccactggccacgaactccctgcagccatccacaacaattcctccaattctatatgcaagattcctgcagcactcgcgatatctcacgtgcctcacaatcgtcacagacgagttgttcgaacatctagcacttccatcgctgcgtaagaaaactctcctcattgtatgctctccttcttcaacttctctacctacaaagtcaagattgttagtggagaatcaaaattgtagcctgagttacaaagaaatcacaaatagacaaatagcaagagagagagatagagagtgagtacagcttattgtgtaatgggtgtgaagagccctaacccttgaaggtctatttataaagggaaaatcttatttagatccatttttaatgtaattataaaagtaactgacaagagaacaaccagaatcacgtttttactcctttcactctatatcttatattatagtaatactaattaattacattttattttttaagacatgggaatggtagaatttatttccacactagttagaggattgattcttaagtccgctgtatgaaaaaactcatatttatggtaaatatgtattctattgataagatgtatatattattaaattaccttaaaagctaatgtaatgaaaaataatgtaatttatggtaaataaattcaacatcccattcattgttttattgtcaaaatataattgttttttttttactttaatccataaaatatataattatattaattaacataattatcacgaacataaattttgatttatattaattaataacatcaatatatatttctattaattcaaaattacaaaatatttaaattaaggcaattaacctttgtcccttattcaaatggttaagtgttcaaatgttagttgagatgacattaattatataactcaaagataaaaattaaaggaacatatgttcaaaaagtgttaatatgaaaaaaaataaaagattaaagtcaaaaactgattcaatcaaaaccactttgaatttgattggataagaataaaattttgaaccaattaccgattagataatgaattaaaaaagttaaaataattggattagattatttttctattaaaaatcgatccgcaaatactatttgactttatgatactcggtattattttttactttcccataaatatatttttttcatagacaatcatgttagagatataatcggatacaatatatgaatattttttctaatgtgaatactaacattggttcggcacgatgtttgacactattttctttagttagacccaaccttcattggttatttgagtgttggatgttactaattttcatttaaataagtctaataaattaaaactagtcaaaattagataatatgggtttcccacctattgtatttgcatctttgtgcacatcctaaattttgcatcatcattctctatcagaatttcatcgtctccaccttactccttggtgtcgtgcaacaagtaatttaatcgatgttgtatattcgtataaattatgacattgttgaagtatatttttactacatagcttttatgcaactctcacccaagtatatcttttgtaatacctaattccatattcgtgttcgattgtcacaagattttgaatgatgaaattctccttgtctgacaatagaggctcttgctaattttctaacaatttatctctatatgatatttgagaatatgagacccagttgccttttttatacatttgttgatcaactccaccctgtcgtgtggtttttttaacgataattgttgatccttgttgttgatatccttgtaggtttcaaacaaaattattccttccataagaaatatatgtccaaatttagcaatattgacttagtaacaattgtttattagtttgggccaactttttttttggcttaaaaattacttaattttttttaaaattaagatatcttcatagtaatagtcaaaaatcttgagactacgaggaaaaagtatttacctaccttactattttgtaaatagacaacctaaaactttaatttaatttattctaccttgatccttaaattttatcttttttgaaaatagattccataagctctaatttcgttccaatttattcttaaactttatcctttttgcacacaaacactttaatttgaatttcatcttaaaattttctcttttgtaaatagtcttatattaatttggggttaaactagtaacaaagaagaaatccaaaccattatttattttaaatcccaatcatttactaattatatgtttataaatcattttccaaatagcagaatataataaaatatagaattaaaaaataaaataaaggttgtttaattttttttctttctaaattcctttttttattatatattaatatactaaaatgaacatgcagtatcacaaaagaagaaaaatattaatcaatgattgacatttaagataaataatttaactcaactatgatagaaataactatctgtaaaaaggataaattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcaattaaaatattgttgtaattaagtatttaaaagcttaactccaaattatttaaaaaaaaaactgaaatctaaattaaattgaaagaatataaattatcaatatttaagatattaaatttatttaactacatcatatactcaatttagtaacgttctgttatttcatgtaataaaaataaactatagttaatatttttaattttctaaaccaagtaatttaataacaaatttcgacctcacaataaataaacataatttataataataggcttcaaagattctgcaatctagtatatacaattaccaaaactgtttctagcatattaatatatatacaatatatacaattactaaagataaacaggacaactttcgaacaagtatttcattttattttttgtgagtgtgtgtgtggaaaatgaagtatttcaggttcatatatagggatgctaataaatatgataaaaaagaataacttgtcagtttttatattcgtgtgcctaaatctggtgtgctttaatattactaattatttttcattatttgagtcttgttaataaaaacaaaattatgtattaaaaaaccttgtccaattactgcttgtttaactcttctttaaaaaataaatcaatttgaacacgtgagtttttaagaaactaattaatccctagccaacgagaagatcgatttccatttggaggacacagtaaaattaaaatggttcagtaaatttcatctttagcttgaaataaataagccatatggcaggcttaggctagctttcacccaattcgtgatcagtttcaaggcagttttaatcctaacacacactgtggaccaccaaattatagtaaaacacagtttttgtgagactaaaactaaacgttacttgaagtagcacacagtttttgtgggggtgcacagataagattcgactaactattgtctctatgtgaagctcttgaactaaaacgttacttatagtaaaacatagtttttgtggggttcacgtatataacgtatgatgccacagaggatttgtctatatgtgaggctctttgccttaaaacgtgagcatcattggtaagtttcatttgcccaaccatccaaagttttccgggaaaccgtcatgtagagagcttttaaacctaaaatccgacatgcatgagaatgaatgagcatctttgtggaaaccgatgacacaaattcatcgaactgaaatggttgttgttcgaaaactgtcttcatgtgaaggttcttgaccaaaaacgtgagcttcacagctaagctttgccaaaccgtcaagtagctcccgaggaaaccgaagtgattgttcgaaaactttacctaaaacgtgatgtgagtgagcatcatatagtaactgctaagattttccaaacgcatgtatcaaattcaaaatgattcctcctttgcatatagacgttttattatgtaagaactcaatttattagtaaatgtaataaatacttgttcagtaattgtatgctaggaaaaaaaaaaatacacgactgtggctatggcaagccaacttgtttagtaattgtgacacatcaaaggcccgatggccgtgcctatggctgccaacttccatagggttcatttgaactcttaattttgattataaaatcacaaaaaaaaattattcggtgatattttattatattatttgataacacaatttaaaaatatgtttatgcatagatattgtttaaaattatttgacaagctagtttaattattactcatttaatattaaacttatagaaatttactttatagtatttactttgaatctaaacaaaaaaggcattgaaatgaataataatatagggattaaatttcataaaaatagtgtgatttataaataaaaatgtttgatgaaaatgatcgtgatgaaatcatacattcagttaaatattaattcatttggttcttataaaaaatttaattccttttttattattattattattattattattattattattattattattattattattattattattattatatcaaatcgatttactttatatttgaatctcaatagttgagaattttaaaagataattaattgaaagaaatattattgcgttaacattgaaacaaaagaaattcatgccctattagaagtattacatttttcaaaaattattctattttacatgcatgtaatgttttgcagaattttattaataatattttcaattgtgtttattgtataaaagaattaaaaattagaaatttctagattcaatttgagataaattatgttgcatgatagtaatcgaatgaattgccattaagtgagacgaagaaattgcttgattaatacactttaattaacagtaaaatactacaaaaaattaatgccctatatcttagatgtattaagctatattaaaaattgattttttttacatgcatgcaatatttataaaataataatacttgtaattattgtcattgtcaaaagaatatcttaaaaaataaaattttatacattaaatttcatcaactataatgcaagatagtgattgaaagaattaaaattttgcttgattattaaactttagttaacaatttttgcaatttaaaaagttaaaagaataaaaagaaaaggggagaacttagactaggactcaaatataaaaattacttttaaacttcaaaatggatccagatcagattagtcattatgtatactccttttattattgatagggctcttcatacccgttacacaataagctgtactctctctcacacacacactgcctctatctctgtctctcattttttctttctatctgtctatttatgatttatgatttgtttgtaactcaggctacaattttaattctccactaacaattattttttacaacaactttgcagttgaaggtagagaatttgaaggataacatacagtgatcgagatgcccacacaatccattatatagcgagtgccgaaggaataatgcgtgtagggttggaagatatgttttggatggctgcagggagttcgtagcaagtggtgcggaaggcactgatgcagctctgacttgtgctacatgtggctgccataggaacttccatatataggagggaagagcaaaatcaagtggtttgtgattgcaatggagcttgaagactatgatgtgttttatatctgcacaactatatgtaaaccaccctatgatatatattttctatggatatgctttttcttgttctgtagttatgggtttccattttatcttaatgatgatgtaatggacttttgttgttatgggtttcatgtgtttgcaaaagaaaagttcaaagttgacaaataataagttttattttggcatgtcatcctctactaacaacacattttaatccaattctttttcgatctttcaccaaatcttgtattgaaatattagaaagcatctacaaaggtgttgcataaattttttatttaattttgctgataattacaaaaatgagctacaacattcgaatccttttgtataataaaaggagcagtaattaactttttccgattacaatgtatatatatgaatcgctttggtcacaacgacttaggcatttgttgttgttgcacaactagaattgaagcattagtattggtatcagaggaagcaagcaaatctccaatcacacccaactcagaaaactctgtccaactctcaagtgctgctgtctgaggcgatttgatcccattacgtctcccaactatgaaaaaatcatgctggtttgcaatatcagacacaaaagcactgatctgagaagattcctcaatagcaatcttttcgtatgacacattctcgatggtaccataatacccctgaacactttttagcacctcatcatccagcatgaggtcccagtttgccacctcactttggctagaaaccaagtggtacacaaccaagttacaatcacaatctttgatggtcctcttagccaagcatagtgcctctctatcatctgaaccccccagaaagatcactgctatttgcttcgttgatgatgatgaagaagaagaacctcgattcacgagaatccccacggagcatggtgctctctcaagtaccttagagttgagagttctcatgttttcatcagttgattcaataccaccatcctcgccccatcttatgtgaaatggaagtaagatgatggaagcaagtttgtccaatgcaaggtaacaaatatcatcatgcatgaaacgtagtggagatatggctgtgtaggtgctaactgatgcagtgccagcattgtcatgttcaaagaggtcgaatgccacaatgacatcttcggagtatttaatgtggcttgggatagccctttcttggagacggtgtgagatgaagatgggagaggatctgccaactaactccatcaaatgcaagacgtgaaccactaaagggtttgttattgtggggcaccaaatgtcaagagcgttttttacggaatttatgtggcttggtttctggatgcatgcaaccacccgaagctctgagttgggtttcaagctcagtatgttccttttctgataccctgcgtacttccttgctgggttgtatagagatttcaccccaatgcgtgcaatgcttcccaacacaagcactgatatagccatcacggagactgtttcattgctcattaactgcattgcatgaggaccaaaattagattactagctagctagttttatagttaagttaaacaagtatttacctattttaatctatatctctttcaatattagccataaaaaaaagataaaattattgtaaaattcaagatcatgtattatatgaagattagtcgggatcaaatgatttaatatcatgtgatctccaccaatctcattctcattaagttaatcaatattaattagatcatatagtcttggactatatacaatacagtcatttttcgttaaataaatataaaatacctaaattaaagaatattatgatataagaattcaattaatttttttgaaaaagaataatttaatttattatttttgtgatatatatatatatatatatatatatatatatatatatgagaaggaaataaagttattctaatatattgcgtggtaccattgaatcaaatagaaagatgtgggtgacgtagtcaacgacacctttgcaactcaacatgagagcgaggcagaaaccatccgttttgggcatgttgcaataccggcaaattccaacagttagaagcatcttaaccaaatgcacagaaacaattatggagaccacaacgagaaccaaggtgccactcttaagcgtggaaatatcgaccttcatggcacaacatgtgacaaagatcggcaaaaggaaccatgtgttgatcatctcaaactgcttgaccaattgggagcccaatggaggaccttctggcacaagaagaccaaagagtaacatcccacctaacacagtctggttagcccacactccaagcaagcctgcgcaaagggtcatgaggaacacaatgtacatgtatgctttcttcacaggtcttccttcttgtgtgttgctcacaatccacctcattgcggggcgtgcggtcacaattgttaatgctataaaaatgaagtattttgtggctgtgtaggttgcaagttcaggtcccttcccttgggaatgatcatgagaatcgagtctaaggctgctcacaacagcagttcctagtcctgtcacaacttggcttatcacatccatgacaagtgctgctgagagtgctaagcgaccaagttcagagttcaatatctcaagatcagagagtagagaagctaccacaggaaaggaacaaccactgtgccctattactatcacgggtagctttcctccatcgaactctcctagggctttttgcgcctgtcccatcaaagtgtaggataccaagagaccaatgaaagtgggaatcataagggacgaaagagcgattgtccaagctttcttccctgttctcgttatcatgctgaaatccatcttcaccccgttcaggaacaggaataatgcgtacccaaaccctgatactaggttcaacacgtcttcactcccgtaagggaacaacagcactttgatttttctcaatgcctctatcttcagagaagggcctagaacaaacccagcctgcatgcaccaattcatttggaaattaacatttttattgcatgtttggctacaaattatttcatttcgatctatattaacacttacaaggaattagtttcatctcaataatctatgtaataaataaatatttatctaaaagttgctatatatgctaccccaactttttatctaatttatttattcctaagttcaatcctatctatgtatagtatatggattgatattatatgatttttcttaaaaaaaacacacacacatatatatatatatatataacaatgacatgcatgcatatgctattagaaaatagtttttttataggcaaaaaatatatattagtaaagaccaaatgacataaaaagtgtcaaagtttggccaaaacagatacaagagaacatatatataaaataaaaacatgaaagcgcctctacctaaacacatacgcaaacatgaaaggctattagaaaatagtgtttttctatgtaattaacatgttgtgccacaaatatgtcatgtggcatgcatgttcttgtatgagacctgcatgcagtaacagagaggagaatggacaaagcatatatacataccatcatttgtgaaacgaaataagggaagcctaggcgcctaagcaccaaatgaaagcattgcgtgatgacgaaaatgcagagaatttggatctctaacagtggcattgttgctcttgaaactaaagcaccataatctctgctaccccatatgccatcggatactatcttggatggcatgtccatggtaatattatagaaaaggaatcttctgtctgggtctgaattgtagtcgtcgaacacaactctactgtaaattgttctgtttatgctgaatagggtatcgtttgtccccatgatgatggatgtttcaagattattaaagaacaaaatacagtagctagttagaatggaatgaatgataatcgttattatcaaatcagaatcacaaatgaagctattcacactaagccttttttatatattgctcatttgtggtggccacattagttggtgtgagttgtgacagactagtttcttagcatcatgactttggaacattgtcataacaaatcataactatatatataacgggttttttagtagcttatttcatctaattaaccgaaacaagaattacaaatatacataacaagtcaaactgccttgtcacgcctaaaccacaaggtggtggttataccgttgatcagcttctcgttaatgttatattcacattcatggaagagattggaacgttttttattttatttttcttcatttgaataatattgccagcttattttttttttttttcaaattcaattttcttttgataggacactaaatatgggggaaaaaacaacaaatagttgtctttctatgttgtatatacttgtatacacgatggataggtccctttttaattgaaattgtccaatttgatctcccaaatttcaattgagtaaattaggttctttttaattgaaattaaatggatgacgagtaatcaaattaagattgtaaaagaatttttttattaattgaacaaattaatgtcaaattaaagcaagttatcctttctaataataatcaaattaatcatgatacaaatttgtgtcgtaattaattcaatttttatttatttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattataagtcttataaccaattttgaaaaaacctctgtaattaatatgtatcatcttataaactcaagttgatcaagatttaaggaatgacaatattcattctcataagagatctctcacatctcctagactcttatttcttctgcttaaatacacaaccccctctatcttgaagtgtctcttttttcagagacttatatttatagcgaatgactaactaaacaacttcttagatactaattccttaaactcatatataaacaaaaaatgatcttgtatgttgaaattaatcataagtaaatctaactaattttatcatatttaatgttatcatttataaaatagtattcatttaactctaattatatttttaatgactcttttatatttgataataagtttcaattaaggatattttaaaaataatcttattttttaaattgagattagtaaaactaaataatattaactaattttcttaattaatgtaattagtcatttttatttatgagtcgaaagggagtaatacaaactaattactactttttacatttccaaagccattgaaaataaattttctaacttccaaagttaaaagtgaacttctgaacttctccatgaatcagacataaattccaaaaacaccattttgtaaaatgcatgggaaacaattgagtttacaattttgaaatatcattccttacggcattaatttcagatatgctcatcattgaatcaagaattacaggtattttggcacaatagatgtgagtctaggagagaaccttctctctatggtcgaactctgaattgcggatgtatagcaattactaggaagatgcactttttgtcttaatactcagaccaggacaggcacaaaactttgtagtgttttcatgttgttaatttggtacgagcaaacttccaaacttttcaatagaactgtttgatttataccagcaggcgcagcaggctaatagaaaccacacacatgacacgaccctaaaaagaagccatagtcatttctcaattccggaatgacaaagcaaaaccccacctcttagataaaataaataaaaccgaccacacacaaagtttcaaggaaaatgatcttttatctcacattaaaacagcactagcttgtcatgaccatcaattaagtacaacaagaaagtttcaagagagagcacaagccggactgcagcagcatatgttcactaaaatactgataatagcacataatttgaatgtcaacttgatctctcaagatacataaaaattggccatcagaactcagaaagtaatgcctgcttttattaatagctactttagctagtcataacctgctacaattcttcaatcctgcagagaaaaagataatagacaaaagttatggcacaaccaaatacaacttatacaagaagataaagaaaatagattgacctgcttagtcacattaccaagagttagtttagggaagcgcagcacaacttcagataaaactttcttgcatatatatagaaaatttaagacaagaaattgttcactaaatctattagctttccaactaagtggagataaagttttacaatacttgattctgaatcatttctattatattgaaaatatgcaagacattgacaatggccatatatgttaattgaaagcaagctccccaaagcaatgtaacaatactcatatgtctagtagagaatgattgtgttggtatctaaagttccactcagactgtgaagcctgggatagaggaagatattgccaccagtgtttaaaagaaacttccatgcagtttaccttataaacatatatatgcatgcacaacaacaaataaaaaagatgacattttgttatttatgattaatgattgtacattcaaatgcattcaattcattaacctgcatatatatgctgatatgcatagttgcataccaataccttgtaattttctagagaaagtggaaaacaggatatgtagattatcgtacctcatcatcgtcatcgtcatcataatcacgatcttccttctttttcttaagacgggtagtaccactttctttgctgatgggtaacttcattgctccaaagggagtatcaacatcaatatgtcctttcatggtgtaacctattccccttcctctaatcatgtcccagagtgcagagccaaaatccttaggcctgaaggtaattggaatatcaatataactaattccacttttctcaattttagcagacttggtgagttctgcaccaccaatgctaacatcaccaagccagacctcgtaatcgagcgcattgaggccaaggtcgaaatcattcttgttttccaacttcaaatgaagagttgcaattgtctcttcaaaagagaacctttcaaaatgaatcttctcaagatcaatatcaggcttgtatggtatggggatttctccagttttctctaaaggtagagttagccttcccaagatgggaacatcaaaaatgagactaaccttcaccctataaggaatgatgcttccaggtttaatatcagcatatgtttgcttgatgtcatcataaatcaaagtgacaggaattttgacagtctgctctccatgtgcatggatggtacccgcatccggtatcattccggaaactagcttcctttcatcactgtcaaccaagtaatctatgtcaatcagagggattggcaccggattcgggttcttgatgagcacatcaacaacaagatctgccttgtgaagattaatcgatggaatgtgtatcgcagtaacgtcagcagttggcttcccaaacccaatagcttcctcaatcttctcaccaatgtcatgaatgaaatccttcaccttctcaatgaatccacccttcccctcctcttgatcatcttccttgtgcttttcatccttgctacccctttccaccacttctggcttatcagatgtcgacatatctaaatcgcagatagtaaatgcacacaacagttagcttgagcatgacccaatcagatcacacaaaaaatcaaagttaaccaaagagtcacaatttaactatccgatcaattatttacaaaagaaaacactgtaacatgctggatcacttgcattagcattagatacaaatatatcattcaaaatacaaactttagatctccatgctccaaaaaatgcagcaaaactcatcattccatataagggtagtactattttttttttatataattacgttttgtcaatggatttcccagtaatcaaaatggaagatagacagaatcatgaggtcaatgcttgatcaattgagtagaatataagataccaactctacaaaaatccaaaatgaagcatggtctaattggcctaaagctgaatcatacatatagtgggaataaagtagaaacatgagaaagagagtagagaagtacctgaaaagtgagatgagatcagtgatccaagtgaaaagagagagaatataactgtgaatgtctgaatgagattaacaaaacacaacaccactccacaacagcagagagatcaagattttgtaggggggaaataattaaataaattataaaaaatacaaaattgtaaaaaccaatatcatcaaagtcttggattacatcaagggtcagacatttgctacagagacatgaataaatggtagccgttgattgaagtcagggttggtttgaccatagaaccgaccattccactctgtaaagcatggtccacacggaatgcacatgtgactgccacattgtttattgtttgaatagacaccgaccaaccactcactttctcaatatttcaactttattaacgttacaattacaaagttaagaagaaaaaaaagtctatatttgattaaaaacttattaattattgagtttaaattattgataattaaacgacttaataaaagaatagtcaaattttaaatatattgtcaagttttacaaattaattaattaattaattgataaaaataatattatacaaacaaatttgaaattcttttgaagtaaaataaaaatataacgattactcattcacatatgtcaaaagagacacgtcgactcatttttttatttcgaattttaattaaacaatcctcactattcaatattttttattatttcaattaaaataacataaaaatgaaggtctggaagaatgacagatagaacagaaatgttctgtttatcgctacctacaaaaataatttttaatttaatcatttaaaattatatgaattattagtatattggtattttaaaaattaagtttaatcttcatacattgtgaatgtaaaattttggtttgactgtattttatacctccaaagttacacaatttcgcaaattttgcctcctaaattatgttttcacaaattttatgccagtgtagtttaagacaatttgtgactttttgtaaattttaaaggaaaatttcacacaaaaaaaaaatatgagaacaaaattcgcgagaaaacactgcagctaaacctaaaattttatatactaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaaggctaataataatatattaatccgactttaagatttttctcttctgctatttctttttctttttctttttgttattgctgagaattcctaatttatggataaacctcatttaccaaaaaaaaaaattatggataaacctcccattcatatacagttgtaatggtaggcagcgaggcagtagacaaaaacatttatattttatagtatcttggacactacattggattcttttgaggtaaatctagcaatatacattggattctcttatattatattacataatgagggtagattcacatattgtcctgtccacgaggccagtgtccatagacaaaatgcaatcagaattctcagtaaattgtctgaatgtctgtctttcaaatacaaccaattagcatctcaaaaatttcgacatggcagccacggattctattataattataatgtaacctaaaacttacgactcacaaaggcaaataaaaaaatgccttggactgatgaaacaaaattatataaatgattcagaccacaaggtatgaatcattactaacttaccaatatagcaatgtagattttactgttgaaataacacttataatacaaggtagaaaaaactcataattacaaggggggaaataagatgtaaggaggctcatcatgtccccagaggagctctgtcatctggtccagcaagcatgatctggcattatttgcatttgcaatttagaaatggtgacaaaaaaaaaaaaataagagaaaagttgaattgtgaaattctagcatatatttaagtttcagaaagacatacattacagtcaaatgcaaatctccttgcaagcatgatggcagcattcctttctctctctgattcaaaagctaatacaaaagaatgcccctgctttggctgccaaaatagtgcttgtgcagcagcatttccacctccgcgaactccacaaagctaaaggaaacaagatcaaagcacaatggttgaccaaattccagtttatcataaatgacaagggaggataacacattccaaagagcatgaaaacatatgcattttcataaacatcaaaatggcttcaaataattcttcaatgcacaatgttagttaaactatgtgcaagaaagaggttagaacattgttttgcttgtcaaaatcaaaatatagatatcatcaactatttgaaatacctgcattgaacttgaatagtattctttggcaattgttgtctttcctttacaaagtttaatcctcatctttccaacatgaagcacatgaatagattcagttggatgatgtgaaccattcatctgtgttacaaccacctgcaaagtagtaaatgcaactacaatattattgtcacataatctgactagatttgccttctaaattttttatattggaatgtggagaaaaagtacaagacaacagcaattcgtcaaaactaaacactacttttaatattttgattacaagactgaagcaagtcagcaacaacccatggaaccatacacatttcagtcaaaaaacagctccatttaacaaggctttcatataattatattaaagttaaaaggataagagcaacatacgttgaattcagtgtcatgtttgcgcactagtgcctctacataggttcccaaaccagcagctgcataagagtacaaaataaatttaagctcgacatgatttcagaacacatgcttcaatctcttaactgataagaaaaaaactttatgtttgaaatagaaacaaatatatagaagcaatgcctgtaagtgactactaatgcaaatgaggacaactcaaattgaaaccagacctggatctattggaccagcggttgaaagtgtgacgtgctcgctttctgaaataatatcaacttgcaatatgcgtccaacatcaaaaggttcaggggcataaactgttttggttgctcctgagaaagttgtattatatgataagcggagataaaaacaaagaactaattggatgacatgtttaataacaatcagccttccagtatcttgaacagaacaacttacataataagccccactgacagttaagattctgattgattaacattatagtataatagccacaaaaagcaagtaagatgtacgaataaaaaaatcattagtatatacaaaaaacaagcaatcagtttgaacatacatctatgatgaaaaaagttaacaagtttatcagtaggtgagggtttgagtgctgccggtatgtcatttataattttctacaaatactaaggatcgagttgccgtgaccaaaactgttattcacattctgcccccgggaagtgacataataaaaagtgttataccagaagttgaaaaatgcataaaccaagagtcaattgacttgcatactcaacaaaaaaagaaaaagaaaaccacagaaacaatacctgagataagttcttttttggcaccatcagatgatacacgataccactgaattgaacattttgaaacttcaggggcattatcagagcaaggttgaatttgcaaataagaacctaacgtttcattcccttcaagttcatataaatgtggaacattttccccacctttcttcgtccttgttaactgaacagtagcatcaaggataatcagtaaaagaagattacaatggtcaatggaagacaatcacgaaagtcctccatttaaggaaagaaacttaacattcacttaagacaacaatatagtttaacatcaaatcccaaattctaattcttattcatatcattaaaaaccatcatggaattttccatcacaccgtgtaagacattagaagattcccccaagtctatctaaagatcatatacagcagcaaaggaataagaaaattcacatgtttgatgtttttcatattgtatttagtttcttttttttttttttttacatcactaatagaaaaataaaagaaatatgaaagaattataggaccatattttcagtattgccagagaatttaacagcatgaaagtattcgctgcatgacctgaagcatagatgacataaaatgccccaatagttgtgatacacacacaacaatcgaaaaagcatattatccacataatctgtgcatgatgtcaaaccatgttatgaacacggattctcaaccgccaaaccaaaaaccaaattgaagttacataatgtgattcatcataacatgctacttaaaaaacaaacagcttaaagtcttacacataatgctgagaaaatatcaaagaattgaccatggatgcatttcacaaaataatcttttcgacatggcataagatgacaggcatacctccttctgaagttgaagatactgtctagtcttctctgcaagttgagccctcaatgcttgaagctcatgttccatatccatgacctatatattaatcaacaatcaatgtattcatcactttgaaataacttgataaaatgttaacgacaaagaaaaatgaagtctaagaaaataaaggtaagaaagccaataaatggaacctagaaaaagagaaggcatttgaaatagcagatatatgagagacaaaatagggacatgtgttcaatatataccttgcttggctgatgcagcattttaattcttcgagcctcttgaacctccctcgttaattgctccaggtcctaaccatagagccaaatgttattcaaatgattattactaacaatgcatagaaaggggaagcagtagctcaagggtatcacataataacaattgccaaaagagtaagatgtttagtccagggctccaggctttcaaggagaacagaaaactagaagggagggaaaacataaatgcaagaaacattgaagaataattttaaaaaataaaataaaatcttaagcataatttaaaaataaaaataaaatcttcagaatatgatatttaagtcggatgcacttatcattatggcatcatgaattactaaattccccatgataaaacatgacaaatgacaagtaaatatcacctgtttcccggaagcttgagacattctctcatgttcttgaagtgcctcttccactctttgaactgctgctctggcatcctctatttcagcacgagcaaaagctctttcctcatcaacaagtttcttagcatcttcagaagcctataaattaatataaactctcagcattggtaaaggaaatttctttatgcaggcatataaagaagatataaactaacaacatatttctttactcctttcttctttttttcctatttctaataaaacttcttccatcaccacataaaataagttaattcacctgcttaagaaaatttgcaagcttcttcacctctgccttctcttgtattagttccccttccctctgagtcaactgaactgctagagcttcaacctgaagaatgcacaaaataagttacagttgcatctcttaaaaagattgcaaatgcacaaataaactagcaccaggatgaatattccattaaaaaaattaaaattatttttctgtgattgaagcaatgaaggtatttagtattatctagataataaatttttcttctacaagcttatgcaaaatttagtaaaaagtattcccaagtttattctcaaagcctttccattccccacatacacactcccaatttgacttttaaagagaacaaacaagaatttatatttatactgtcagcttcatacagaataaatatgaacatatatctgttagatagaaacaaatgtgaagtatatatcttcttttaaaaaaaaaagaactaaccatcgcaatagtttcttctacatcatccttgtttctgcctgccacacgcccttttaaggattcaagtgcatctctaagcttcttcaaaagaacatgtttttccaatgatgctgcctctctaagtctagcctgaacttcaccagcatacaaaaagctagttaaaaaagggacatcagtttattagaaaactatgaatatgatcattggttatttcagttgcaaacattttacaataagaatctcaggttgcaaaaccctccaaaaggaagaactatattcctaagggaggaaatgaatttcaatcagaaggaagggtaacctcttccgacaacttagccgcggccgccaaacccttctcgaatttactagcaaggtcgcgaacggagagacgattatgctgttccaacagctgtgcagtctcacgagcaacaacatccttcattgatagcacttttgggtcatcctttgtctctattatctgattgttagctccaattctgtaattaggaaaccgactagaagcaaacagaacatcagaagaaaccgcaggcacagcctccctttgcattgtatcaccaaaatcacgagtcaacctcgtcatttttcacaaccaattacctctgccaatcacaaaaacacgccctttagcaaaggaaattcaacaaattatagcttagaataattaaaaaaaaaaaaaaggaacatacacatactcagatatatacatgaagaagagaacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgttttcaaagttttccacaaggaaacaaaaccccgcaattcctttttttttttttttttttttgagttgaagcagtgaggaaaagggtaacaagaaaaagacaaaaagaagaaagctttaacttacaggtcatgagaaggtagaaaattggtagctaggcttgtgattctaggatcagatgcaaaagggttttctccaatttggctatagtacacaagcagtggtcagatcaatggttttagagagagagagaacagagagaataagcatatacacagcatatggatagagagaaagatgaaagctttgctttttgaaaagaggaagcgaaggaaaaagaataggttgtgttgtgccgcccgtgggtgaactggccccccctttacgggattttagtgttaacgttttgtgttatgttgtgttgtctttgtgtgaacgttggccacaaccacaaaaacaacagctttgaatggaactaggcttacttggatccttgtcttaaagatgttacatacaactacaactatgttgttatgtttgttgctattacaactagtagtattgctactaccattaccattacctttcatcatgcttatgctttaaacttaaatcttgtccatttcagggtcccattccatggccttcctagctgttcaacgtttacttcactcacacagcttccattttctttttttgcatcaaaaaaatttaacagtgccaaccctctctctttttcttctttttctaatgtttcgtctgcaattatattattcacgttcaatgcattgggggttgctttccgtgttagttatttgactgggatttgttggtggtgccagtggagtcaaggaaaacttctcacaattataaacttttttaagtaaataaataaacagtatatacatccattgtagactttatattgttattaaataataataaatatttccttaatatactaagaatgtattctaacctcagatactaatcctgattgtagtgtatgattattgctgatccgagaaaaatttaaatataaattctctgattaaataaatcattttttacatataaatctagcaagtctgtactgatacaataacattatgattttgtcttatttgttgatgttaattttgtcatgattattttagaagtaatgcttacataattcctttttagttgatagtataagaaaatttataataataatacatatttttttttaatataagtagaaagaatttgatatgctaataacagtttttatgtgcattggttggtagatgaaaagtttctacttttctaaaaaatcttaaaataaaaaattatgattctcatatttaatatacaattaataaaaaagtttttcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactatcaacaaagaaattttataaaaaaaatgcatacgaaacgggaagtcaattcataagaaagtatgtacattattggaaagttaaaataaattactttgagaaaaatatttttctctgttatgttttcattgaatctatacaagaaatacatcaccaacaactgcaagaagaaaaaactaacttttacctatgcagcttacaaataagcataataaataactgttatccagtaaattttgaaatcattgctccaatgatgcaagagcatattccccttccacaatgtgtgcacatatgaattattatggcatacattggacagttgacatattgctataaaaaataattctttcctaataaattaacctatttcagaatcaatcacaattaattgcttattaccattaggtctttatacattaaatggaattaccgcgctgctaattcttttagctacaataactgcgtttctaatttgctataatggctatattgttatatttttctcactcctattgggcctctatacatttaattacttatgaagttgggtatctatattaataacaattttttcaatgaacaatagatagatgcatgtagtggctaattaagggtttatcatgactatattttcacattagtctagaggatgaaagatacaatttgggtaatatattaacttaattggatgcacttgcttttaaatcacattatactctaatgaactctactttacatgagacccagaggatctcacacattatgaccatacaatttgtatcacgttcacaggctccaaaatattcatttgatgtaaccacaaactacttacgcattgcatgctgttaggcaaaatatgatattctttctttattgtgtcttactctaactaaaacctaaccaaataagcaatttttcacatttttattttgttggggggaaattcattgacttggtgttagaatgtctttagagattccatcccctactgcatctcaattatttgcgttgggccttcacctcaagttaagcacaacgaattacttttcaaccttaatttatttttattaatctaataaaatcgttaagtttttgctaaagttattgatacatgcggggaacttataagcccttctttttctatgctatgtaaatatcttgatagtgatttattatttgaatttagattttttctaatttttacgacatcttaaattaaaaaattacaaaatttaaataaaaaaatattcctaaaagagcaaaaatctccgttgagtaggacatgtacacatgggaagggccaaggggctgctagttccttatctcaatcatgttcttgtctttttattaattttcatttgaaaaaacaaatacaaatgcaatcattgtcattgttttgattcattcatcaatgcaatatgcatcacaattcacaaggcaaggtgtgatggttgattaggaactccttaacttttaaggttgtctttttcactactagaaaaccagcttttaacatcggttattttcgacatacaacatcggttccgacccgatgttgaatcaggcgatgttaaaagtctagaacttaacatcggttcccaaaaccgatgttaacaatagtcaataacatcggtttcccatcaataaccgatgtggacatatgaaagctgaaaacgttgaaaagtagctacatcggaaggcaacatcggttctaaggtaaaaccgatgttaacgaagaaaagcaacatcggtttcatttgaaaaccgatgttaacgaacaaaacaacatcggtttggctgtcccaaccgatgttaacaatgtaaaacaacatcggtttctctaaagaaaaccgatgttaatgaagactatcaacatcggttttgcttacagaaccgatgttgttgtgatgttacaacatcggttttgttcttaaaaccgatgttgttatatcacaacaacatcggttatgtaacaaaaccgatgttgatttgtaggttagcatcggttttatctacaaccgatgttgttttttaatttttttttatatattttgtctgtttattggattttgacagttcttcaacctgaaaattacaaaatccagatccagccaattcagtatataaataatattccaataataatttggtataattattttcaaatgtacatatttgattttcctaagctatatacaattgtttgcaaaatccataacatagaccacctagcctactactaatacatcttctctaactttgaggaaatatttcgcccattcgacccttatcgccttcaacctgtcggcctccaatggtctttgatcagtgaaaaactgcattacataataaaacatgtaaggcttacataaagaaaacaagtaaacaacaacaatttgttttgaattaggcaacttattaccgtgtcccagctatctgtgaagctcccttggactattgtctgcatccaatgcatgacataatagccacactcagtgcttcctgtttgcttattacactaaattgaaaaatacagtcaacgttaaatggcaattagcgtaaatagtaatgaaaattactagcattttgggaaccatgatttatgaaaacacttactttaagcgcaatccatttagttgtagcctttgatttattttctggagagtcatggactcccttcaaagcactgtttaagacaaacaagtatgcaaagtgtacaagttatctttcaacaatagaaacaacgtaaatatgttagaaattagaacctacctgttaataattcccttaaggtagttatcaggcctgttatgcaacgaacaaaaccaggcgactacattggccttcggacatataactaccagttgccaatgtgaactgcattgtgaaaacaaggttattatactgcatacattaatgaaattgtgattaacatttatactgacccattcaaatacggtgcaaggtagatttttttctgtgaagtctgcatccatttcttcatatagtcctcaacttgaaattgagattggccagatctctgtatggactgtggctcgaggaaaccgaacacatcggcatgatcggattacagacttaaatgactcatatgcctattgtgcagtgagaataaagtcaattattgtagaatatataacaattcactaaataatgctactcaattgaaagagacttacagcatccacaactgtataacagagatgtttagacattgaccaccatggatgatctccgaaagatcctcatgcttgatgtacaatgggaagttgtcattatgcaccccgaacatcagcgggtcccatggcacctggaagggtctgaggaacagatcggggatggtcaatgctaaatggtacaagggatcagaaacacgttccagcttatctacaggttttgtcggtcccttgggttcttggttatcctacacagttaacaataaatggtgagcgatcagcttaactgcatatgtgacaaatcaatcgtaattcataagaaatcagtcaaaaatcaaataccttagtcaaaattgtatgtacaaggtgtgtcggccaagcaaggaaagtgttaagtgcctgccccactaactgaatctcgtcagtgggaacagggacgcgagcgtctccatcgcgtacttcctcaacactaacctttacatgatcagcggcaagagggacgccgtgcacagtcgtggatccctcatgaactctgccaagggcaacaaggcggggaggattgtcatccacatacaacccacgcctatcagatgcatccgtgtctcgatcattacccgagggatcaacacagcttaccttggtgctgacacgggcaccaagaggacacgactgaacctccggaggctgcatggcaccctgagactggatgtgggactgcagctggctgaagctcatcatcacctgctgggtgactctctctgtgatcgactgtgtaagacgatcagtgatggactgctccagctctaccctgatgttgtctttcaggcgatccaagtcttcaggcgccatggatgcagatttggacttgcgagaggatgatggggccggtccgaagtactgagtgatcgtcacaccagctccagcaccacggacacggccaggatgctcgggtcgtccaatggcagtagtaaggacatcctggcgaccactggcaacaaaagaaccctgtgtggattgctcttccagggaatcctgcaataaaaattagttgggttacataattagtcacaatttgtgagaaggaaattaattaaatgtgtatgaggttgttgtgtgacttacaatcctctcagcaatctgtcgtgccgcctccgaagtcatctcgccagtcttcttcgtgcgagcaagcttccacttcacgtgccggcgcacaggggacggaggatgaatgacggtgtccgtgctgtcatcacgagttgctgcctccagttgcttcttttgtttttcctccatcaatctcttctctagcaactcgtaacccccgcgtgacagcacgtgaggtgcggtgttttgcttttggattgcctgggccttctttctaacatcctgttacaggtagacacatagggttagcaaatagttaacaatatagcagcacaaatgagaacttgtaggattttgtaaaacaacatacctcccaggaagctgctcgtcgactctgacagaattgggtccactgttcgtgactgatgccgtatttactacatacagcgtcggcatcgtcgtcgttgcctcctgcgaggacccatttccgcgtcaagtctgatttgaattgcctccaccgctcacccacggtctgcagaatcttcctctttgtccgttggtcggacgcttcagggatatcaaattcagcctgcattaaaaggaagttagttctcaagttaagctaacatgaacaacattttaattgtgtaatgctttaaattgtaatacctgaatgtcctcccaaatcaagtccttctgcactgaaggcacttccttccaactaggaagggtgatatccaccttgtctctggccacgatcccaagatatgtccttaatttctttgcctgaggaccatcagccttccctgtgctaggatccacatggaccaccggtctgtcagcaccaggagctctagtagccagtgacctcagccgtgttgctttcctcgtcttcttcgatgtagtcgacgaaggtcctgcctcaagaggaggtgcggagtcagcatgagtcggtgctgactcaggaggaggatgtgctggctcaggatgaggaagtggtgactcagcacgcggaggggagctgggtggtgtagtcatgatcctgtaaaacacaataacacagatcagtcaagttaacttacaagttaagttacaagaacacatatgaaattgtacgtacaaggcgaaaatagttaagaaacaaaaattacattagctgatgttaattaattctccttcatcatgatcattacgatttgcatgaacatcgtcaacctcgttttctgtgttgacattagctatttgtgtagagaaatgaggcacacttgtttcgccggttgagtcatcgtcgtcaacattaatgccaatggtttttccgtgtagtaccactgaccacctttcgtcacacggatcttgtacatagaagacttgtttagcttgttctgccatgatgaaaggttcatcttcgtaagctagcttgttaaggtctaccaaagtaaatcctacatcctcggttcgcacaccactattgacattaacccacatgcacttgaaaacacagacagagaaagtaacataattaagctcccatatgtcatgaatgactccaaagtaaggcaatgacgccaaacgtggattgtcatcattgacagtagcaaagtgctgtgactcagctcttagactaaccccactgttctgcatggtgctcttatcatcttgtgctttggtatagaatgagtacttgttgatatcgtaccattgccaacttctcacatttctttttgggccatctgccaacttcctcagtgtttcagatgcagattcatcagcaaatattgtatgtttaaaccaattcaagaatgtcttgttatgctctttcaacagcctattcttcgtcattcttggattactttccttaagtagtgcttcatgacgaacaatatatggcagcacttcattactgttattcaagacatacaaatgagcttgatacaattcctccaatgagggcgttataacatgtagccctcgtgtaccttttcctcccactctgtcatcatgtcgcaactcgggaagaccaataggttttgctttctgaaggtactctgaacaaaattcaaccgcttcttctgcaatgtacctttcaactatggatgcttcaggacggtgtaggttttttgtataccctttcaagatcttcatgtatcgctcgatcgggtacatccaccgtaaataaactggtccacatattttaatttccctcaccagatgaacaagtaagtgaaccattatgtcgaaaaatgagggaggaaagtacatctccaactgacacaggataattgcggcctcttcctccaagccatctaactgtgcagggtccacgactttcgtacaaatcgcattgaagaaaaagcacaggcgacttatagcatgcctaactttgttaggcaaaatgtttcgaatcgccacggctaacagttgttgaattaacacgtggcaatcgtgagactttaatccaactagttttaaatccttcatctgcacaaggctcttaatatttgaagagtatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttctgtcactccacccatatttggccttgacattcacaagatttaacaccgcagacaacagtgtcaatgactccttgcaccctggatacaacggcttcttcgaatcactttccaacgcatcatacataggggcatgtgcttgcttaaatgattcatgtcccagatcacgaatcatatcatctaatcgatctccgatgtcgacatcaggcggttcagtttgcaagaccgtttgcgtgtctgtcaattcaccatgccatatccatgtcgtataagtcttcttaatcccatcgcacagaagatggtcgcgtatgtcatccagtagttgccgtcttccattcaaacaattaatacagggacacaaatattttccatccccatccggtcgacttctttcggatgcaaatttcaagaaatattcaacgccttgttcatagtcaaccgtaatgcgacttgcattcatccaagttcgatccatgtcactaataactctggcatactcacaaagttatttcatgcatgaaaacctctcttttttcattgaaggtgtgaccctatcccattcaagaagacacatttttatagtatattcatatgtatagattgcgtttcttatcttaaatttgacgaaatttcggcagcatttcgctttgatctccgaatacacgacatgaaagcggtgacatgagttccaccacagtcaagtatgcacccggagaacaaaatgaaatgcattgtaccgaaatttcatcaaatataagaaaagaatcacaacctacacatatgaatatactaaaaaaatatgtcttcccaaactgtccgaacggacaattcaagaatcaatacaatgattaatccaaactgtccggaagaatcactgtaatgaatctcaaacgggaaactaaggttcactcatcatgaacattaattgtacaaaaaaggcaacattcaaacgacaaactaacattcaaaaaataataatcaaattcgtaagtacctgcgatgacggtcactgacaatgtgcaaccacaaatgaagtgatgacgatggagagtagaaaacgacactaattaaaagcccacactgcagatggatgctctaaagctgaacaaaggatagatatttgttaattttctgcgaaactaacaaacaatataggggctggttaagaggttttctgtacaaatttggctataattttattgttttacaattcctatatagaagccattggatgtcaatgtaagacttccatttaagccactacaattgattaacccatatagaagccaatcacaagttcatacattgattggtgcatacacaataatacctttcaatactactcttgcaatagaagccaatcagaagttcatacattgaataaaatattgtttgtcaaattaaaagcatagtacctgagagggatgcgccaaagcaaaatatgggaatgacaaccaaataatgggaacctatcaagcgactgagccaaatcaaaatacaagcattagaagtagaatgtttgtaaatgtagtcaatattttatagtaaaatgtgtttgttcttacgcagggaagagatgcagaggatcaatcaatataatcttgatacaagtctcagataatcgttttgtaaacctgcaaacaacatgatgacaatatcaacattactgcaaataaattaccatatatatttatatgatcataaggaccagatcacatcattataggagtgttcaatgtcaagggttgcgctattgaataaattaatgctatgtttgtcatatttactggagtattcatcatgaacttgggtttcatttgagtctgtaaagcaaacacatgtctactagaatttggatgttgatgtcacatacacacacatctctatatgcaataaatgttcttttcaaataagttctacaacaagactatttgttgccaatacatggaatgtgtgtgtgtgtgcgctatgtggctgcctatatatcaaacaagtcctgcccctaattcctaaaaatgaccaaaacttgtttgttgtgtcacaacatagaagatgtgggcctcaaagtcgtttatttgtggagaactcatgtctacatggactgacccttgaagagttttttttccatgccatgtgtggtatggaaggtcagcagaaaaagttggaggctgaacctggtaggagatgatattatggatggtgtttggaaggtattattgaaagctatggaggacatcatggttgaatatgatgggacagtttacaaactgttattcaaagctatggatgctgtttggattgaaacacagaagttggattcccttaaaatgaaaaaaaaaactttcagaagttggttgcttcgcatagagctgaatcgtcaaatgatgatggataagaagttgagtatggctgacattgcagggaagattaacattgaatttgatgatgatttgacttgtatatttaatgatgacgatgcgttgatgccatacattagtcgaataaactctaccaacacaaagacttatgcctctacaacgctcctgtttctacaagatgacggtacactcaagccactggctatagagttaagcttaccccatgcacaaggggaacagcatggagctgtgagcaaagttttcactccagcacaagaaggagtatcggcttcggtgtggcagctggctaaggcttatgcagccgtcaatgattcaggatatcatcaattggttagccactggtatgacatccagaaaagtgttacaaacttaattctgtttctgttcttaataaggagaaagctatgtttcttgtgcaggttatacactcacgcagtaattgaaccgttcattatagccacaaacaggcagttgagtattcttcacccaatacacatgctcttgaagccacacttcacccaatgcatataaatgccttagctcggcacacgctcatcaatgctaaaggggtactagagataacagttttccctggtaaattcgccttggaaatgtcgtcctttatatacaaaagttgggtattcaccgagcaggcactacctgctgatcttcttaagaggtgagttcagttattgattttagtccaatctgttggagacaagtattagtaacatactattttctaacacacactctttattctagactaaaatttattataaaaaaacacaaaattatgtgagttactaggtctcacttctcattcatgattgtgtacttactaattttaactaatggtaaaaagtgtgataagaagaatgtgttactacttgctagtatttctctccataagaacatattaacatactagaattctataattcactgaatttcaggggaatggcaattcctgattcaagttgtcgtcatggactaaggcttgtgatacaggattatccgtttgccgtggacgggatagaaatctgggatgcaatagaaagctgggtgactgaatactgtaacttctattacacatccaattacatggttgaggaagacagtaaacttcagagttggtggaaagaagtacgcaacgagggtcacggtgacttaaaagataggcattggtggccagagatgaagaccaaagaggaactcattcaatcatgcaccattatcatatggcttgcttctgctttccatgcagctgtgaattttggacagtacccttttgctggatacctccctaaccgtccaacggtgagtcgtaggttcatgccggagcaaggtaccccagagtatgaggagcttaagtcagaccctgaattggcattcctcaaaaccatcactgcccagttccaaacacttcttggtgtgtcactgatagaagttctgtccaggcactaaaatattttcccttttcttatagtcaaatgtgagatatttctgttgatctcctaaatgatgctattaatagcccaggcataacatcataaaaaataaaacttatgcatcaaatgtaaccgcatattttacttaacctcttctaagcaccaaacagtaagcaaaacagtgtcacatctcagaatctggtgtacatggaataaacattgaagacaaaaaaggtaaatgcagcacacatcacatgctattagttagaaaaaacaaatgaagttatatccatactccatccacaaatagcacacatcagtccaaacatacattacttactgtcaaaatcaaacaaacttaccctagctactgatgctggcttgttcctgaaccatgactcttagagtttttaaaactggacaatatagccttattgtcaactaaacaaacttcattgacagcattgcacatcattcaatatacctccctaacctactagtaaactaaacaaatttaccctagctactgatgctggcttgtaacaaaatagaagacaatagaaactgtttgagcttccttaccagagatgggtcttcttgattgaagatggtgagcctttgatcccttaggtcacgaaggcttagaatgacagagaggcacctatgcatagaggcacgagctgagaatgacagagaggcaccaatgcagagattgaacaaaaaggaaatcagtgtttaagttgccaatataaatacctggagcgagaatggcagagcaccaatgcagacgggcacgaaggctgagacagcaacagtagttcacggcagccacaccgacagacaccgcgacactgagagtgagagcgacggtgagagagcgacggtgagagagtgagagagcgacggtgagagagtgagacagcgagagacagagcgagagagacaaagtgataaagaaagaaaatgggcgccaggaaaatatactatataaaatacacaacatcggttctctaagaaaaaccgatattattgacataaattcaacatcagtttttttaaaacttaacaaaaaccgatgttaacttaaaatagtcaacatcggttttgttcggtttttaaaaaaccgatgttaacatcaattgttaacatcggttttcatcagattttatgaaaaccgatgttaacatattgagttaacatcggtttttctttcataacttgaaaaccgatgttaacgaagtccatttatttacaagtttgccaccgcgttttcgttaacatcggttttttcaagaaccgatgttaaactagcgatgttaaatcctatttttctagtagtgttttcagtaggagagaagcggaaaaagttataacagcaatgaaaaataaaagaaatgcacactgtcattagttcggttgaactgaaagttacaatatatatataaaatatcttcagaaacaatgggattcacgagtgtaattttcttcacaaaactgagataaaagataaataaaaaatacaataaaaatgtgaattcgagtgttttcaaatttaaacttgttggctcataggatacgcacacgcgcagacaatattttttttatatttgattatgctgcatttcacatttgattattatggttagcaaaattgattatgatggagacatattcgaatataaaaaatgttatttgatacgaatagtttttttgtgcaatttacacaaaccttgttttgagcacttgttttttcattaacattttttttaatgttttaattatatttattttttaaaaaaatggtattaaagtacaagaagtcatgaaccgttcgtgcgtttctcgtgtttacgctattcatacgtactgaatagcagtactcttcgaatatttgttttttataatgcatgctcagtgagaaattgaatatatctttgtttggctagcaaaattgaatatgcgacttgctttttataactcatgcacaaccacaagttaaaaaagatattacactttaaatcattatataaatgtttttaactatattttttcattttattacctattaaatcatttaaatttaaaatattcacctcatttcatctcgatctgaacaatttcactttcatctctctttcattttttacactttcattcctaattttcttttctacctaagtgtgggattgtatacacgtataagtatcgattttccacttttccaaaaaaccaaacatgactagaaatggtatcgattttccacttttccacttcgaatatttgaaggatttacgttaaagttaaacagagatatacaaacaaatccaacttcatatggaggtaggttatatacacaaccccgccaatgatttagaaatggtaattatatttataggatactaagttaattacagacggtggacccaagcatccaattgtgaaaaggaatgctctcaaaggagggagagggatatctaacaaaaaaaagaagaaggaataaattctttttttatatttctattttgaaagttataagaaaaataatagaagtttattttaagtagtagattaaccaaagattcattttacataaatttagtattttaacctttaaaatgtactgaataaatataaatatttatttttatataatttaaatttgaaaaaatagataatgcatgtaaataaattagagttatcaaatcacacctcattatatataataaatttattaacttttataatatctcttaaaaattatattaatgatgttttttattgatacatgatcattaaatttttaaaatttatattaaataaatatttttaaatacataaaattatattataattaatatttatgataaataaatatttttaacatatacactacattttgaatttatgataaataatttatattatgatacaagattttttaattattaaaactttatttaaatatatattgaaattcaattttgaaaagaggacgagaaggctagattaaaagagataatcagttaaacaaaattaatttaaaaaaattactgtttattgttaataataaaaaatacattttattctctttaaataatactatttgtttactttgtgagttatttttcactatcattattattagatttagatccaaaccctaatcatagttcagaaataaacatctaactggagttttcacttttcagcagagaagcctctccgattccggcacggtggtcggcatagcatttttcggcggctcatctccgcaccgacgtgagttgacgtaggaatcgtaaaaccaacgggaaagccttatccggcacgtgagttcgttatctctttcccttctctgctgtgaaagtgttgagagttttatgagtgctgcatgtttcgatttatatttgtattttgtgaatatctttatcaatgcaatctataagtttgtttttgttcgtgattctagctgtctaaatgcttcttgttctgttctggtattggctttactatatacacatatattctgtctcctaatggataatacattagagctttttatagtcattgatttttcaccttcaagcttagaaacttctttgcaattatttaaatttgatttgatgtaattagccaaattatgccgttcctttcatgatttgatcacaccttagtagtatgcagttgttttatgtttgtaaaataggttaatatgatgtaggtacagataggtggcctatttaggttggagaaattattaggttgtcccggacaaccatgttgtggaatttgctacccgacaccgcgtacccggctcggcaccacaaccttctgctcggatactcgcgtactcggcaccgctcgtgcccggcttcctcgtacccggcagaacacttctcctcttcggctgggagcttcctctaccaaccgcaacactggggagtcactcgactcaaccctcagcaacaaacacagtaaatatgcagcggaaaacaatcaaacagtaaacgagagaatagatagggagaatcaacacacaatatagcttaacgtgggagaaaacctccaagaggaaaaacccacgggaccacgtccagaaataatccactattcagaaataatggttacaaaaccgctcgacagccacctgccggagccactctcagcctcgcttacaacagaagtgaaacactctcaacaagcagctctcagctctcggagacactctcgacggctcactaaccggagaaacactcactctctgttttcgctcagcctctcactgccgcaccttgcgtcagcctctgaaatcctcgtcgtctctttctcacctcataatgagagtatttataagagagacatatttagggatttaccctaaaaggaaatgggccaggacactgccttgggatttgggcccaatagcattggaacggaatatccaacaaaccacctctcttatctatggttcttaccaatttttaggcgacatgcatccaagtttttcaatttaagaaaaagaattaacaacactcgattatatgtcatgtagagattagttgaaaccatgataatctagtaatacctaatcatttatcatgatggtggtcatgtagagattacaatggcattgttatctggcattcttatgatgaaaggcctattggcgtacttatgcttatttggcctacttaagctgataagttaactaaccttagacagtcttttagacctggccagacttttaaacaagttaagccaaacctaaaaagaggctatgcaggtaaagaggtcaagctttgtaaataggaatgccaagtttaacttgatctgacatgtttctatccttccttggaatgctttttcttattttgccctcttttcccttttatttttgtaaatttgtgttttcctatgttactcactttcttcaattcaccatttcactattgcatattatttctctttctcttcctacaaaacccccatatcaaagattggaactttcaacaccattgaaatttatgaacataaaatacaattatccatttgtttcaaatcatcaataattgctttttttgggtgccgtgacagatatggcagataaagatgaagaggctatgccaagggacgcaaatattgtgaagtctttgatgaaatcaatgggcgtggaggactatgaacctcgtgttatacacaagtttcttgagttatggtatcgttatattgttgacgtgttaacggatgctcaagtgtattcagagcatgcaggcaagtctgaaatcgactgtgatgatgttaaggttgctattcaatccaagcttaacttcagtttctcgcaaccaccccctcgtgaggtaatattagtaatttgccacttttcaatctccttacccaatggttagattttctttcacatccaaaaagaaggaaaattattttgtaggccccacctttcaaacaacttgccaagcttggcaagaaaatctttcaaacaaacaagccatgaagtctaggcgtctattactacaacttaagtaaaacctattagaagaaaacagttcagttctgttactttctgacaatcatggtactaggacctgtaactaacaatattaatctcagcaatagatttctactttctagatagttacggtgtcgtgaaatatttgcttgcctgaaaggatccctgtccatttggtgacacacaataccatctgtttttttttccttcaagcaatggtatgtcatgtcttcctgaaagattgtttaatgtaatcacttggcaggttcttctggagttggctcataaccgcaacaagataccattgtcaaagactatagcaggaccttgtatccctcttccacttgatcaggacacattaatcagtcccaactacatgtttgcaattccaaaccaaaggcctactgaacctatagaagaaacagaggatgaagaagctactaatactattcccaacccctctcaggaagagcagattaatttagtctagctcacacgtaacaaaaatctataaatttttagtagcttgttcaatttatttattctttgtaaagtctactgggttctgaaattgaaacaaaattgtttccaaacggctcccctcttgtggtcagaagtcctcgtgaacacaatgagatattgatcgaaaacttggtgaatactgtgtacctttgttttgtacttgatagattgatctggctgcatcatatgctgtacttgagtggtttattcaaaatattgatgatgcgagatgaaatcatattctgaacgtattgcttaagctttcatagttatttatatataacagagaccttcaagaatcatattctgaaacatcacacatccatctacagacacttcatcaaatacttttttggggcatcaatgagaatgaaacaaccacacaacgtgaaagcattgtggcaaaaatattagaagagaagaaaatgagagttcacaaagctcactcaatatttcctagcaatatttcaaattctgctttacacaaaaaggaatcatcaaactttgcttgaggcttcaagcaattcctagcaaattccaaatactttgtgtatcacactgaaaaaaaatataaacgaatacaaagccatataatatagatcataacagtcatgatcgaggcctaaaataacctaaacttccctaaagcttgttcaagacagtgctgacaagtcctttgctggagaaagaagagcaacagcagaaagatccgagttacagaatttcttgtaaactgccctaagcttacttcctggtgcagcagcatgaaggttgcccatgattttggcgcaatccctggcatcaaaaataaacaagagtcacttcatgaatgttgaaaaaacacattaactacttgcatttttaaaataccaatttgctggtccaagaaaatattaaccttagttgctcctcagagtagcctgtgtagtgcatcaaagtgtttgtccagaaagggctccttccaagggtacatcgagccgcaaagacagcagaagcagcaatcaaagaagggcggtacaatattacagtaggataatgcatcaatccaagttcagcaagaaaaaacaccatgttctccatctacattgacgaaaattaggcatattcatcaggctattccactctggaatcttttaaaaaaaacaaaaacttaacaaccaactaccaaaatatacctctttgtcagatggagtggaggctttggtatacctaaccaagaagtgatagggtgttggaactgttaagtaccattcaagtttcctaaggattgttttctccatcatcaacacttgttcactaacataagcattgtctgatatgcacacaaagtcattaacctgcaaacatacattggaaatccacaccataactcataagtaagcactttctcaaaacatgatccataaatcatcatagaagagaaggaattccacctctggtgcccatatctcttcatattttgaggctatcagcattgagctgatgccaaccagctgaagctcccttctaggcacagccttcacagacaggaaccgatcgacaatgttcaaggtcaaataaagagtttctggcatgagctcaaacttcctatgcacttctaccaaccagtccacaaggattgacctcatcttggcattaatatctggctgcgaacccatgtagtcatgcacacaaccatctttctgtttcatcaaaatcaaatacatgtatgtataatataagaagtgcataggaaaaggggattatagggattaaacaaagaaaaaagcatagagcattacttcagtctctttgtaaaatttgtagatatcatcgatgtactccgctgctgccaattcattgtccatgtcagttgcatcaatgttcaccacaaaatcccttggaagtccacaagcagcctgaagttaacaagctgttagaccatgtaccagaaaaagggcaacccacaaagtcccaaaccacattcagaaaaatgaagaaaaaaggatcaaccttgcttctagcagagaggacagaactgaaggccttggcattcttcatggaagatttttccctcgccttttttcccttcacagcttgcttttcttctgattcatcatcagagctaatcacaatcacttcaggttcttctttaggcttctttgctgcttccacctttctagcaggaacaaaattcccaacaccaaccccatcagctaccactgctcccttgttcacttcagtgcttaatttctggataacaaccattcatacagatttagagacacatccgttaccaaaaagaaaacaaatttcttcgaaaatcagataggtaaaaactaaaaagtcctaaaaaaaatcaggggaaagagaataacaaccttgttcttttctgttgcggcttgtgcattagccaatagttgagcacgaaagttcctagtaaaaaagaaaagagcagaattaggcaaaagaaaagagaagaaaaattatgagagcttaaaaaaacaaaacatttcaaaagaaaagaaaaaagaaaaaaaccttgttacaggtttagacacgttaattccatttccatggccttgtttacccacgagattcccaatatcctgtagcacccttctgtttcttccttcaccacccttgtttttctgcttattctcatcaccaactaaaccacacaaaaaaaaaatcacaaaagggggattttcagaaacgaaaaaaataaaaaaccaaactttatcaaaacaaatcttgaaacctaaaacattcaaacatttatcaacaccggtagcaagaaaacaagaaaaagaagaacaaaaaccattgatgggttgttgctgttgttccaatctggaagccatgataacactttgatgcggttcttgagacgttgacccgaaaacaccgccaagagtcgagaacagcgacgacagaaaaccctgaagacctccgttccgcgcctctcctccgccgctcacgtcggttgtcgccaccgcggaatcaagcactgtgtttgtttgtagttggtagcaaccttttttcctctctctcttttgcttctacgccgaatgtacgaaacgaaagtatgaaacagtgtgttgtttcttggtttctttgttcctttgagaaattgaaacgtttgggtctacggctatgtttttttatacgacaacaccccacctccaacggtcgattctatattcaatcttgaccgttggattctctttggcatcaaaggctactattcgtttattcactttccttgcgtttttttatagccgttactctcacttctcattccctgagtttaaccgctcctcctgcttttgctaccattgcatcttcttgttcttatccctttttttagtactaacaaataaaaataggttctggggttaatagtaaaattagtccctaaagtgtgaaagtgtgatgataaattgatcttggaaaatacaaatctagtttatgtgaaaaaaatatgataaattagcattaaatttgtgagatcattatattattaagttataatgtttaaaaataacaataaattatattttataatcaattaaatattaaattataaaatttaaaaattaatttgtcattaaatttgtcataatttttgtatattcaaaaattaaattttaattcttcatctttatcatatcaatttgtcactaaactctttcaatttctcttcacttttgcactttatataataattaattattagtataatagtatagttatcgacttagtattatagaagtgtcctttgatttatttttaagttaaactaaatttatcattaaatttttacattaaattttctaaattgtttttaaaacaagtaagtattgaatatttctaattacatttattaatttgaattctttaaataatatgtttaaagctctaattaacacttgcttattttaaaatagattttagcatgaaataatgctagtatgtctattaatgaaggggttgacaagattttcaaaacctatgctttgaaaattaacggctagttggatcgaaaacacctgtaaatcagaccaatttagttgaaatagatcacataatcagtcctgagaataataagttaaaaaaatttaaaatcagtcaataatcaataaaatattacaaaattagttttaattagtaaaaaatggtttaaacaacattattttattttattttatttttcttaaaaatatgaaaatcaattttaggtgtttgttatgttttgcttatggacattgttgtgtattaccaaaatgtagattttaatattatgttatattttatgtaatttgattaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaattttcgacaaaatagtaggttgtaaaaactggcataaaattcccaagtagcaattgagacaatataaaatcctttttctccactaatgacttaccgtttttataattgtttcaaatgctaaagaattcagtcatgaattttgtaaggttagttttactaattaatgccttaaagttaaaaaataaatatttttaaattattttaaaaaagtaagtattaaatatttttatatatttaatactttctgataaaaacttttactttaatgtctttaaataatatttttacagaattcattaattaatatttactaattttaaggaaaatataaacataaaataattaatatttaccattattaatataaaggagatgtatctaatcagaaaaataaattattataaaatgacaagaataaatttgaattataaaactataagtgaatgattttacatatttttcagtttatattaagagtatttcttcaacagaaagagatcaattcttcttaaattaaagatatgaatattgaaataagaatgggtatgatctcttcgtcttttaattttcataatattagtacgtagcacatactagtacaattgaattttaactaattgacctgttcaagaaacctaactcctagaaaaaaattattaaaaaatgacaagaataaatttgaattataaaactataagtgaatgattttacatatttttcagagtttatattaagagtatttcttcaacagaaagagatcaatccttcttaaattaaagatatgaatattaaaataaatatgtgtatgatctcttcaaatcaagtcttttaattttcgtaatattaattagtacgtagtacgtactagtacaatcgaatcttaactaattaacatgttcaagaaacctaactcctattaatcaattaaatacgtccgtttttattggttaattaaatgggtttttatatctgtccctaattaaaaccggtcaattatatctccatgaaagacactagctaacaacaagccacactcttcaagggttgaggccgggaacacacattttggcatcaaatttgacaaacatagggcaaatgtgaccttgaacgaaaaaaggaattttgtaatgtttctaaacaaagaattaaccggatttgatcatccaaagattgaaaacaattatatgcagctgaaccttcaaccttgtgtacatggtggaactgattttgttcattattttaattgggggcaaatattttctcaaacatcaaattattgtggtcattacaactgctaaaaagttttcccaagaaggaaattaaccaccatatatatatatgccgaaaagcagaaagccggaaactataaaacaaaatggggatatcccaggcacccaacaagttcatatttgatcaaatcaaaaatcggaaatgacaaatttaattactgatcaaagattcagaattaattactaattaactattgtcataattaagtggctagaagttatttgcattaagaaattaaaaagtcatactttacgaaagctatttatcctgtattgataattaaaccttttaaaaaattaataagtaattaattttgagaggaaatcgtcactttttttattattaaaaaggctaataatgcatgtgtagctttgtgaggaaaggacgtcgcgtaggtgcatgcatgtgataattagctggataagtgcttttctaagacagtcatgtgacgattgacgttgaagtcacgatgcgcctatgtacgtgtcatgatttttaccattcccattcgataaaactctatttagtcaattgtttagtagacaaaatttaggacactttgtatatcccaaaaaaataattattttctttgtagttgttttttactggagatggaatatcgaattaaatagagaatataacattggcaatgtttagaataaagtatctattttttatcttaattatttattatattataaaaccaatattttatgtataattttcttttttgtgtgactatgatattagtgtgaaataattattaattttattgataataattaatttttattagagaaaatctagttatttttaatgagatatcttctctgatttttttttccttaacagtattcaaccttaatttcttgcttaagaaatctaatgccactcagacaaacaatacggtacaatcagtccctttagagcaaacacctatatattttacttgctatattcaagttttcacgttaatcaaaacacacaagataaatggtctgtttgagtaagtttatctagaagcacttctaaaaaaaataagagcaaaaagatgaaatgagtttttccataagtaaaaataaactctctaactaatttgtagaagctcacaaatataacttctctaaaagatgagatgacatctacaaattagctaatataatatttattttagtttatgaaaaagctcatttcattttttttcttcttacttttctcttctagaagtacttttagagaagctaacatccaaatatgtccaaacattgataccttaagaaatttagtttccacaatgtgtacatacattatagaaattatagtttacgtatcatattagtaaaatgaaattatagatttatgtatgaaactacattaattatgaaaactattttttggaaaatctgcggggtgggggaaccctcaccagacagtgaagaagggaaaggaaatgaggagtactactcggagcaagaaaagataaggtggaagggaaagtaaaatggcttaaatgaggtggacgtgagagtatttttggtgttagaaaactattagtgagggtccttttggtgttagaaaaatacaataaaaggaaggggtgtgaaaagaattaaaaaaagttgtcaaaagaaatggtatttttcttcttatcattaatgaattcgaattttagcctttttttatattattttccaaaagaaagggctagaatccacacattaagtgatgagcttcctacaccattcattatttctcatacaccattatattttttattttccaaaaatacccctggctgttctcttatatttgtcctacaccgttttcttcgttgactgcgctttcccttttgaaacttcactcacttcatttttttggccgttggttgttggaaacgctgtgcattggttgttttgggtggcattgtgttgatttcgtcggagttgtggcgtggtggtggccgtcggagtcgtgaagtggcgtcggagttgcaggtatgttttttgctgtcgtacggattgttcaatccgtatggtatttacggattaggaaatccgtatgaatcatacggattcggtaatccgtatgaaccatacggattaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacggtctacaagaagggacccgtcgtacttcgagtatgtggatgagttacactctgtacaaaatagctgttctaccccgaaacagtccagttcgtcttccgatgttctaatgaaaaaccggagggttccaatgctcaatcaatttgccccattcatgcagaaatttattgttgacataactgatgtaaaacctgatggtaattgtggatatcgagtaattgctgcctttataggttacggtgaagacgcttggtctttggtccgcaatgatctgctgaaagaacttgcacaatggactgatcaatatgtgttgttgtttggtggtatagataggtttgagaagatcaagcggtccctactagttgatggaatgtcgaaggtatgtttaaattgtgtttctttcacatgaattggggtaacgtaactctgtacaaacatgcatataatatattcgattaactgataatttgtaggtcacaatggataagtggatggatatcacagatatgggtcatgtaattgcatcaagatataacatgattgtagtatccctgtcactgcagcaaagtatgacgttcttccctctaagaagtcaaccgcctagagatccccgagttcatcgaattttgtgcattggtcatgtttttggaaaccattttgttcaggtaagacataacgtgtttgtttttcatatgtagattttattttgaagatagattaatgatttatgttgcaatttgatttatgtggcaatttgtttaaatcaggttactttggcagacaattgtcctttacccttgacggcatgtttgtgggatagtcattgtacccaggaagctcaacagtggccgtataattacattgatcgaatgcaattgtatattaaatccatgcggttgcccacggaatatgttgatttaggagatgtataaacactggtttaacaatgcaaatgtatgacttcattgatatataatgtgaagtagacaaaatagtgttgttgcatacattgctgttataagtaactacacaataatgatgaacatggtttctgtcatgtcgaataacaaaatgtaatcataaaataaatgtcaatcacgagcactggaaggcctcctccgcggtctgatagtccgtctagctcgggtgtacacaatgccatcgtcagtcacacctcgaagttgatgcaggatttgctctaccatggagtatgcatctgtgccttccgtaaccatcctcatgtcaagcatatgttggaggccctcagcagcacgttggcacacatgctaaaaaaaccaatggattatgaacaaggcaataaacgttaattcaatttcaaataaacaattttaagaagtccaattttaagaagtcttaccacggcatgcactggtctctggtaatcgacatcactgtgggactgggtatgggatggtgcaggatgggatggtgctggctgaggcactggtggtgctggctgaggcactggtggaatctgggcataagcctcctcataccgagctggggtcatgaatgggtgggaaactcggaagaaccaccccatgtatgcagcaccacagtgacctgcataatcgaccaactctccggtgggcaccaggtagtctaggaagtgggtccacctatcatcgaggtcttcaacagaaggaacatctgaggatggcagaggtggaatgtgctgaacatacccaaactgcctgaccaccctctccggtaagtacctggtcagatgaggaccccatctgaggaatccagaatacatcgagattacctcaaactccctgtggatacggtgcatgtcatatggtgtccagcatacatctgacggtgtcaacctatctatacgtctacgataggttgtcaccggtaaggccttcgtgctcttccacctgcaggcacgaggttgcctctcatcgtactgctcatccgcaacctcatttcctatactaggaaaatgctcatatatccagcactacaaatttaaaacaatacaagtcagcaaacaatgcaaacaacacattcgcaaccaataaactgtgataattacagacatcatacaaggacattacctgtaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagatgtagcctgcaagatgtttcccgtgatgcttacatgcgtagctcaggtgctcatacatgtggacaagggcaccaacaccccatgcaagacctgcagcccgatcaaagtctctgaaagcctctaagaatgccacacctatatgtgtggcactcttgttggcaaacaacgtgcatccaacaaggtgaagtagatatgccctagcggcgagtatccactgtctcgactccaccttcgcataatacaaatcccggagccatgatagcctaacataagcaccgtgacactgtgtcgtctcagcggatgcctcctgtacagtcacatcgagcagctctaccaacaacctgatcgcgtcgccgatgtctaactgctcgtacgtgtcgaatgtgcccataacagggagatgcagtagtgatgacacgtcgtccaaggtcagtgtcatctctcccacgggcagatgaaatgaacatgtctcggggtgccatcgctcaacaaacgcggatagcaaccccctgtctccagtctccactgagcatccaatcaatggactcaggccggtagctgcgataaatccttcaatttcaggtacaggcttcccgaatttaatgaccttacggccatgggaagcaagcttcaactctggacgttcctgcattgaacacatcatttaaggtaaattatcaatggataagcaaatgactttcagctatgactatgtcattcaaaatctcaatacctctcctgcccagactcgtacagccacatgatcggcaaactcggtaagcaccgaagaatcttccggccctccggggaaagattcaccagctgtgtccatatcgtccatcacccggtcaccaatctccgcatcagtctcaggcacgggaggatcatcatgaatagcaggaggatcatcctgaatagcaacacctgccctatgacgacggacagatgcggtaggcctccgacgctcaggggcatcttcagaatgacctctaccatgtgtaaccgcagaacggtcgggactccgaccaacggcccgacgcactcctcctctcgtcctagccataatctgcattcacatagtgtttttcaggttttcatcttcaacaacaacatcattatatacagatttgtgtacatggttatgtatactactgtcattcaccaccagatgtcattcatcagttcagagcacaccaaaccaaacagacatcaatccataaccattacatgtcattcatgactagaaactacaccaaaccaaaccaacattggtacataaccaccacaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccgtacgacacccaacaccggttcgccgttcccattccgccatagtcgacctgcaacaccctccacagaccaccatctaccagtttaacaattaaataactcaccagggtcacaggaagcacgaagaactggaactggaagaatgaatgctgcggccgaagaactggaaccaccaaccaatggcaacggcaatggttgaagagggaagaagaagaacaaaggcaccggcaatggttgaagagcgaagaagaagaacaaaggaacggcaatggcacagggaaggagaggcaatccgaatccgtttaatggtgtattaggaagggaagtagtcgcggcagggagaaggagaagacggagagggagaacaattttttttaaaaaaagggtatatttggaaaatcactgtttattaatggtgtatgaggaaaataaaatggtgtaggaagctggagcccacattaatgagaagaaaaagtccatgaagaatgaagcggtggagattaaatgtacaacaacaccacacatattttgcctttaactatcattaaaaaaaaaaaaaaaaaaaaaactctagtccaaagtctttaactatcataattaagaaaaaaactactctagtccatagttcgctgacttcactcacttctaagttattttccatttaattagactactataactgcaaataatgctcttacctcatagaaaggtcatttttatcttagtaaaaatgatatattgttattagccactattatctatatatgacatgagcaaggttatgtagttttgatattttcaatcttgatttatcacgattatggatttttactctttcggtcaacctctttttttagattctcaagctgccatggataccaactttaaaactttgaaatgtgttaaatcactacattcagttaactaaatgttgttttagaaatttagactttgaaatagtaatatctcatttcttttctttattttttcatcaccaatttctttatcctaagaaactattttttattgatagcgaatttgcgtttgttctgttcactttttctaaaagaaagccagaaattgagctatttttttcttgttctttttgtcacctgctttctcagtattagattgaaaaataaaactaagattaaacatacaatttagtcatgtatgtgtacaaacctattaattaaatcagtcactatatgtgcaaccgtaaccgatttaattcctaccatcatacgttaattttgaactcttttatgcattcttgtctttatacgtatagttcattcttaatttaatctttatacatgtattttattaacttagtccatatatgtgtagtttattcttaatttaattccatgtgtaagtaaattgtattatgatatataccaactaatctttgcatagctcgtaatagatgtgagttttattaattcttttttctaaattaaaaaattcaattatatatcacatagaaattggttgagattgaaacataaatataggccggcaacacttgtgatggtttccaaagatccaatatgaccacttaggtctaagttgccacaatattgttctatggaagccacggactgttagaagtttggcccggtttttttttggtgtgatagtttaagattatctaataaataaactatcaattcgattccttaagcgtcaccctctctcctaaataactctttaactaatgaaactatataagtgattcctaaaatattaaagatcatcctacatagtcctcaagtattaaaaaattcttcaaaacattgcctaatgttagtaaagtatatcaattcccagtaaaaactaaattgatagatatttaatactttatttaggttctatttaattatataattttattattttaaatattatttaatattttattagtttgaagaccaacaaattaaagcacacctaggtaaaacgtaattaattaatttaacatgttttgtatgtagcagcaaatgcatccggccgccacatactgctaccatcgtgtcacttccttgtgccaccaccgcccggacccttcttcctcctcttcttttttatataagaaaccaccaaaactagttccaaacatcactagctagctactcctcatagaattaaaacaatcatatatatgtattcatatacctacctccatatattcatagagttaaaacatcccttctcttgtgaggattaaccatacaaaatgtccaagtttagtaacgataattattttttcatcattaataacattaattattttaataaacatgcatatatatatatatatatatatggaaacatttgtatatataagaatgagataatcaaatttgaacagtataattatacataaattattaagattaaattttaaaaaatcatatattttaaaaaaactcacatgttttttttaaaatagttacataataataagttttaacagtttatatttgattatactggtcaaatttaatttttttatctataaaatacatattcttctcaaataatatgtcttttcttatatatatatatatatatatatatatatatatatatatatatatatataatatagaaagtgtcgtctcatggttaatttaaaaatttcttgtagattcgtttggtactgaaacagttgagaaatggggcttagcgagtctctgaagctacatgatgaaaactcgaaggtggcagcgggtgtgagtgcggcgatgtgtttgatcttaggtgggatctttgtgtttatagtgtcttatgtctgcattcgtcttcgctcccaaacccatagagattagagacgtgcctgccgctgtcgccgtcgtcagcggccaagaaacggtcggcaagtgtcccgtctgcgtttactcgacggtgaagaaggagaatgtggcggcggaggagtgcgccgtgtgcttaggcgagtttgaagactgtgatgtggtaaagatgctaccaaaatgtgaacatattttccaccagcattgtattgatgcgtggttaccctcacacatgaactgtcccatttgtcgcgagaaggttgcgtttgataataatgtctcaatggaagaagaagaagaagaagaagaagtactaggtatagagtccgaggtggtagggacaacagcggaacctgaaactgttgtgggacccgaggaggaggaggaggaggacgttggacaagtgcactctgagtctgagtttgttgcttgaatcgtggtaggattttttaattccctgtgttggtgcattttaccaacattaattatgttttctgactaaattaaaactccggttcatttttctagttatgtttcgtttgtttatgaactttgtggattcaaagaaggtgcatttgttaacatatatatgagattttattaaagatggtgaaatcaacaatttcttttacaaagattaatggttaccacttaacaaaattattagaaacttcgtatctataaacattgaaaaaaaagaaagaaaaaggacgagtttattatctattaaaaaaagtgaccttgctataaaataatttaatattttgttttaaaaataaaaaatataaattaatttatgcttatttacaatcataaaaatcacttttttaagaaaaattaatttatgataagttatggaaaatagcttttgatttaaatcaggttttagattattttgaccaatcatgtttttttaaatgattatatttttaaaatctttcctggaaaataatgtttacatgttgtacatgtttaattaagagtgtataatgtagttacgtagagagtaaatgaccttaaagaaaatatatttgcctactagtcgtcgtgtagagataaattatatatagatgttgtccttaagaaaatcttaatatcgaaggttgaattagttgaattaattatgggattaaattatgaaaaattcgttgtatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatatatattagtatatgctgtatttttttttggatcggttgtgtatttgtctaaaacaatttatttttttatatccaaattatagctgaaaacataatatcacattagggtttggacatcatttcaggaccaactaacctctctacttgctaaatataatgcaaagtcaaacccaagtagttgcattgttttattgctatattgaaataattgtatgtgtagaattccaacactgcactaaataacgaaggtacaaccaatgctgtgttgttaaaggggtgacattttatatcaaaggatatgaattcatgtcattttcaatgtaacaaatacatctatttttcccaggtattttgattgataaaatatatatgacgaatagtgacaaaacttgagtttggtgcttcttgacaagttaggaaaacttcaataatgttcagttactattactctaaagacaaattaaggcaagttaaaaatactgaattgacttacggaccggctcaattctttctaactaaaagcaagtcatcatgaagagaataaattttgaataacaataattaagtcatttacaaaacaatcgaatattatatgttagtttgtttggtatgttttataaattttttaacaaattaaacggatcatcctttagaagtacagtagataaaatgctctagttttgtcaatatttcctcctattattttaaaagaacaatcaaaatagaaatgtcctacgaagataagatatgaacgattaggagttttccctttatttattccttgatattctaaaagcatcacttattatatccaaagtttataataatgaatgagacatctaaccaagatatgtcaccgacccaccgttttggctcattccacgtgtcaactatcacatggctatttttgttgggatccagttgaacagaaaaactaaattaaatgtattgaaaaatatgtaaagaaaacaaatatacttctatgacacaaattattgagagcaagatagagcagtgagtattttagtaattcagcagaaagtgagggcttcataaccactctggcagcacaagaatcccacattcttattctcttaagcttgttattaaaaaccagtttcactgtgcttcatacattttcacaaaccccaggaagaatggaacagggaagaagaataagctcttttggtcctatgttctcaattgttccttgtcttctcttcctttttttctgtctctcaggatctgctgaggcctacaagaattacacagttggtgactctttaggatggtttgacaatactgaaaagtccaatgtcaattaccagaagtgggctgacagtaaagaattcagcttaggagatttcctcagtaagtttcttcatcatcatgtttttctgcttacaatccttgtttgtgtgttttgttgttgtattcgaaagaagtgactaagtagaacttgaggaattttattgttgtcaatgtttttagacaatttcttatggcatggttgttcttgtttcatttccttgatctgatctccaatttgcatttatctggttttatttgactgaaactcaacactactatgatgtctaatcagatttaggaaaaatactggattggaaagaccgatcatattacatcactcatcccataacttttcaatgtttttatttttttaactttttttatctttgcttttaaagcaatcaaagtatctattttctcttcacaattcctctacccgtcactatgatggaggagaagcaaaactatatcatttacttatatttttattttggaatttgttttacataacatacttctgagtgtcacaaaaaataggttggcttcaatcatagtactattgtgtgttgtttccctctgcagcatatatgctgttttttgggtacgttgtgccatattcttaatatattaatgttagtcgatttagaaaaagttaggcttaaattggaagtactaagagaaaggcatcactactcttgttggtatttttatggagtctgccacacgatccacaaccgttagtctcaactaaagtattcacccttccatttgacgcaacacaatagctaacaaagaatattactgttagttaccatttgtccctttttgggtagaagggaaaaaagaaaaatccgatacccaaaatgacttgtgacaactactagtagtactttttattattctttttttttggtacaaatattctgttttgatactctgattgagtggtcactcaattctactagtttaatttttcttttatgtaaaacttgtaataataatattctgagacgaaggaaaaagtgaggaatgggatttgctttaaagctattagtcaaattgaagctaaccacaaaccattataattataattggcgatgattaagctatcatttaataaagccatacgttttatgaaacataaattaagaaaaagaaacattgacttgaaccaaacacttagaataaaccatttccacgtgtagcaggggagcattcagttgggcaggaaagtaggtaattctttgaacaacagaccatgccaatgttttacagttgccgtctattaaattttctactcataatcctattgaatactttgaacatggaggtgttgttggctgtttggtattcatatttatgatatcctattttcacctcacaataacatgctttgaaattaggttgcaattcttgcaagcatcttgctatacaatttgagtataatttctatatgttgggtgtaacaaattttatacaattaatcaaataattaccttatacgaattttaagatatattattataagagtcatcaaaattattatatactagttgaaaaagagacactttctttctttatttttattttttaaaataaacagtaaaaagaaaaaacggttgcaaaaactagtgacaataattatattttaaaggttcatgaaaaaaataaaaaaaattatatattaaagaataattcagaaatatgaaatgtatatatcaaaaggagtaattatctttaatagttatagattatcatttttgattgatttacatacagatactttactatatggttacatatattactcatacaattttctctatcatgctctattatgacataaaataatcttacctaacaacttttgatttttgggtattgttgatgcagttttcaacacggacacgaaccactcagtgattcaaacatacaatttcactacatacaaagaatgtgactatgatgatgcacaagacaaggacacaacccaatggtcagcagctgatccatccaacacccaaacacatcctgtgacagtggcagttcctttggtgaaggaagggatgacatacttcttctcaggtgattatgatggtgaccaatgcaagagtggacaacacttcaaaataaatgtgacctatggacaagggttgccaaagagtcttaaatccccagaagatgcaccatctcctgctagtcctgttgctggagatgatgaatcagcaccagacactattgttccttctaatttcagtcaccccaaagaagaaagtgatgatgacaaagctagtgatagtgacaaacagaaatctagttctatttcaatctcaatgtatgcacaacttcacattgtcttactaggaatactacttttctggttttaatgagtcgagatttgttttatattattttttaattatagatatatgctactattattttatctatttttttattgggtgtgagtgagacagtggggttttgagttgagttgtgagctaggatataccatatgttattgctgtaaactaaaataatgtaacaattaattacaatcctttattgctatatgagtttcaatttattagatcaatatatacattgcttgtccctttatctattctcgagttttcccccctcctttttctattgttgctggcaacttcgagagtggtgaagaattagtaaagacaaaatacatggtgcctgaggaaaggataaaatgagacataaggagggagttggttggaggttgtaattattgagataactaaaagtaactagaaatctgtttgataaggaagtgtttttgaaagattttttactgagtaaaactatattttcaataaagtttcaaaagctcttctaacttgtacttatataggccctaattggttatgttttgtttattagcactactaaaaaaaccactaaatcattaataatgtcggcacctacccatatcaagtatgatgccatgacatatgatactttcatgtaaattcacgtgattatattttatgtcagggtatgtgaaagcacgtgtagcggcataaacttattttttctcaactttcttgacttctctagctaatttctttaggcttgatttttttaaagattttcgagttcttaatattctaggcttctcttaactttaaaacaccattgtttaatgttttttaagtaagcttacttcacttatactacaaattttaacatttttgtattgtgttatacagtttaattagtttttatttatttattaaatttataatataaaatgcacttgcatccaaatttaggatttcattttgccattacatgttcacacagacatttcctatgtgttataattatattttactctttttgcaaacattaagtctaaagttataaacattaagatttttgtattcatttgtcgcaaacaaacatttcctataaaaatgttttgatgaattgtgaatttgtaatggaaaacagagaagcgagtagtctatatctttgggttgagagagaataatttttcaaacacatactaaatttagggctggtcataagaatcaaactatgacatatacaaatgtgtataaaaactaaaccaaatattgagatccataacaactaaaagaagaatagtctcaatgataatgaagaacaactacattgttttttactcttcacttccggtgttccccaacaacacatttttctttccactcttccctcacttgaactaccattaatacatgtatgcaatggagcttgtcagtgtctttgtcatgcccaacgacgacgcttcaatgacaatggtcgctgccgccgccaccaccacaaccaagtggttcaaaattgttgttggtacacatatgctctgtcccaccaaatttgtcccaaccgacgttatcatctttggagatgaggaggagtaacaatatcatcacacgagattcgcctcttaaatttcatatctgaatcatatctagatcatggccagtggcggagccattcccaagccagcaatggccatggcatatgctaaaattattaattcatttataattttttttattatatacagttttattgatacacttaaaaaattgataattggtatagactaaaatttaattggcatgggctaatattagttgctggctccgccactgatcatggcgaaaggaagtggaggaacgacaaagagcgtgaagggtgatgaagagtacgattcccatgcaaaatcaccaccactttatgcattcttaaacaatgaaccaccaccaagcccacttgtgtgtgtttgtgagatttgggtttcgtttgcaaaacactgcatgaatatgagccttcatttgtctcagatctgttggggttagggttaggcttgggtttgacataaaaataatctagatatggtttttgttgtttgaagaagatgcaagcatatgcaaaaaacacccttgggtgagattgggatgctacacatcttggggaatgctttgtcctctgataagattgttgagccaaggcatgcccctttgattcctggcatggaggttaaggggattgccatttgggttggggcttttggttgtaatccctttgatttttcattataaaataaagatagttgcgatttttagttgtgattagagtaattatttcaaaatttaaaacattaccaatgttgacagaacactaatgttatgaacaaaaaattgaagaaaggaccaaacaaaaatttgataatttattagggacaaaaacatttttaaacttttaaaaaatatttattttaatttttaggtatttatttcaactttttaaaataattagaagttgaaaaagaataccaaatttgactaaattcaaaagctattttaagttatttctcataaaattatttaaagaaactgaattttaaaattgtaaacaaacataaattagatattttaatctctaaaatattgttttagaccataaacactttattttttaatctctttgcatgtttagtttcttgtagatggtgagtcaagtcaaaccaagtttaactcaaaagtaggttgtttggtaattaaaataaaaatcatttcaattagggaaaattatggtggaaaaaacaagttaacactaaatttagtataaaattttaggattgaggtttgaaaaaaattggagattggagttctgattcatggtttagtgatttgtgatttttcttatcacaagttatcgatttgaattttaaattatgttttagtggattgttgattttgtgtattaaggattattgattttgcttggtgcgtcaaaaaatttattgtgtcttatcactaaaaaatgtctcaaactaacaacatttaatagtgtgattgttacattaaactagtaatctatgttacgagcccatatgtctcacataatcactattcactcaggttacacttgatgaacacaactaaaaacaatgacaaaaaatggttaagaactaagattgataaaaaaattatcttaggtactaaagttgaattacataaaaagataagaggattaagacctagaaaaattgttgagaggtaaaaaagtgaatgtcatgtgacatgacaatttatgtaattgtcaatgacattgctatatcatagctcttaccttttggaagcataaaattgaaggatttttttttttaaattagtgagtctcacaacttcattaccactttaattcaaatatttattctcaattccatttaattctactttaccaaacaaaagcttagtgtaacgccccctcaatagtcagggtcattaccaagcataaccacaatcaaccagataatcaatcagagtttaagcagtttggaagcacatatataaaagtgacatcaacaaatgtcatcatcagatacactgtacatataatatggtgaatatacatatatctctgtttagatacaaaactgtacaaataacccctcagggtataacaaaatcaaaaccaaaggctaagtacaaaacatcagagccacatgctcatatcatctagcctaaggtatgcaaacagcagctatccctgcataggcttcttgccttgggatctatctgctcctccagatgaatcacctgcaacgtaagtcccacaaacggggtgagatataaaatctcagtaaactcaggacccttgaaggtatttccttcccctggttcactgacaaccacacatatgtatatatgtgtcaacataacataatcacaacagtgaaacgttcaatcatcatcagtagtgtacctcaatacacatccatctatctagaccatagtctagtcatggcatacaatcatgcatcatatccataactatcatgcagaggctacatctatgtatataggaacatctcctggcaggatctctatgcatctatcagaggctacctccgcatatataggaacatctccatttaggaggcaacatctatatgacgggaacatctctttatagtgaggctacatctgcagatataggaacatctccaaccaggaggctacatttatatcgcaggaacatctcaccctctacaacaatacaattgcctgaggaggctacctctgtgtatatgggaacatctccatacgggaggctacgtccatatcacaggaacttccctcagcagggcttactcaactcaatcatctatcctactacaataagatactattcaagcacaacatgcatatacaggtttcacattcaaccagacatgccacaattcactcacatcatagccatgcatatcaatcccctatcacagggttcagttcacatttcaagcatagcagatcaatacatctcaatctccctttcatagggatcagaataacagtacacagcatctatatacatgtatactcaattgtcctaatcaatcaggcattcacatccaattccctttctcagggtcaaatacacatcaagtccctttctcagggatccatcatcactcaacaactcatggccatacataatacttacccatctctgggttcagatcaaatataaagcatcagctaccctttcatagggttcagacaacatctaccattcattcacagcattatacacattcctctactagcacatacacatatcataaccataatctcaatggatatatatatggtggaacgcagtagaggatacacaaacaagaaccatgagcttacctgctctagacagatttccggctctcccggcctcgtggtcaacaccaccagagctatctagctcacgtcctacacaagaaccagtacataacatatcaaatacggttctaggtcattcaaacgaaaagagaattatcatcctctctatcaacatataatgaatcactacacaagtgatttccggaccctaaacaggatccttctcagcctcaacaaggctacagagcctccacaaagactctgatcaggctaatacaaagcatgtccctactttagccttctcaaagtccaaaacctcagtatcagcagtttaagctcataaacctcatctatactctctcatgagcaactttgtcaactgatctaaggttcatactagtcatattactagccttttatctctgctcatacatactcagagccaaaatcaaacttcatcagtaatgatgattcaaggctctaactccctcagaatacctttctgagcacaaaactctacagagtctgagcctaataacggctctaacacctccaaagacacccctctatatacccccataacccacaaaatccaatacacagaaccaaccgttagagctcgagtttcttacctctgtgatgttcagaaacaccagggaatcaatttccctaaggtagctcgctcaaacagggcctcctttgcctttaaactccgagctctcaagggttctctcagagaaatcaatctcactgtttatcgactattctcacgaatcaatccgggattttctctcctctcggggctctgatcactttctcagttgggctagaggtgtttagatgaaagataaagaagatataaagctctgtaactcatcaatggcttcctctctcttctttcctcttccattttcgtcccaaatgaccttttatataggcctgcccgaagtcccgcgctgatagcgccgttcccgcgctaatcgcgccatctgctcgaaatacccacgctagtagcgccggattcacgctgatcgcgtgaattggcctcgaggattggcctgattcaagcatctcacgcgaatcgcgccactctccgcgctgaccgcgccacaggctcgaccaacccacgctgttagcgccacaaaccacgctattagcgtgaactagccgcaaggattgtccttgtttaagcatcccgcgcggttagcgtcaggccccgcgcggttagcgccacatgttcgaatcagttttctcaactctttctcaagcttttctctgaatacccttaagcatacttattatccttaatcatgagcttaatctaagcttaattacatgtttaaaatccaaggcattacacttagcatacttgttgtcaaggacaaaaaaaatgttgtccaaagaaattaaaattggtcaattttgttgtttaaggattaaaaataaaatttgaaaaaaaatagtttccaaatacatattcaaccccaaaataaaacaaaccctagagtttatagattataaatgcaaataaaggcctgctagggtgaatttatttaaacttaaaattcaactttaaaataaatactttttatataagtatttttttaataaatgaataaaatttgcttcttaaaataagaaaaaacctattttttagtataaataatttacataaatatactaaaaaataaaaatcacttattttattaaaataaatacttatttcagtaaataaattaatcatatttaaatcataagtttttttttgagagtttttattaaaaaatatagtttttttgatagagaagttctgaattgagattggcctagttggaattctcttccgaattgggcctaggggtgacttgaagaagaggtagagaagagcgactagtcctactacgaagcaagagtagaaagcagtcgtagagggcaagcagcgactctttctaattcatatttaagagcacaacaaataagagtttgagtttgttggcgaagaaaggtatcacagagaaaagaaaaatggctgaatcatcgtcgtcgtcgttggcgaagtctgacgcggaggtagaagaaatgctggatcggatgctgactcgtttggctctctgcgacgattccaagctggagccgctgctctccaagcttctccccctctgcatctcctctctctcctcgcaatccctcgccgttcgcaacaaggtcatcatctgtctcacattccatttccgaatcaaactctcaatgcgtaaattcgtcgtgttttggttatgcatatgtaattggttacattaaaattgaaaatatctctcatctgctgttgcgattgctgtgtgaatcgatagaaactatcgctgtttagtgagagtaattttgctttggcatggtaagatttgttgcgcttgtaagaataataacgaagagtttgcgtgcatgtactctttgatgcaaatttgtcatcaaactgtgcgagtgcggaaattcgttgtgttttgatgcaaacattatcggctagatgaaataactcctctctgctgttgtggttgcttaataaaccgatagaaattattgctgtttagtgtttactgagtaactttggtttggcatagtaagattgtgttacacttgagtttgcgtacatgtacaactgttttgcacggtctatttcatcctctttgatgtgattttgtgaagcgattaggtgactttttcatgattgttgacttgtgtttctgacaggtgctcgagattttgagtcacgtgaacaagagagtgaagctccagcctcaaattggtctacctttgtctgacttgtggaaattgtattcggaatctgctgctgtccctatcataaggaatttctgcattgtgtatatagagatggcttttcagcgtgttaatgcaaaggtctcttctcgttctttatatcttagtgctgtttgttattattattttgtggctttaaagtcaattttgatgctgataattcttttttcagcagttgtttaaattttcaaaagtaaattatgttttgttgtcggataaatagataaattgattggtttgggactctttgaagaattttgttttctgctattgaatgcttattgtggagactatctgacgcaccatgcattttgaataggaaaaggaagatctggctcctgatctcttggtgaacatctcaaaacttccacttcagcaccaggaaattatccttagaatcgttgttaaggtatcaacatccactatttaactttgaccaaatcttccattgtcacggttataacttaaaagtacagtcgtagaagacttttcattgatcattttcatggtacacagtttttgagttggtaatattaattgttcagtgcattgagaccctttttctccttattctatccaagtaaggcttcagttttggagaaatttctttcaagggaattgggaaggatataaaaaggaaaaattagagggaagttctaagtttttttgcttgggaattgacataaaaggatttttttgatgggaagaagggtctactaccaacactaagagaacttggatttcttgaatccatgggcttctgtccagcatccttttttaaaaggaaatttcttggtctattttcattgtgtatatcttagttgttcttttgttcttcctttcactatcctattgaatagcaaagatcaccctcagttataaatcttcaggatatgactacttatggatttctgcttccttctaggtaattggtgaatgccactctggtcaaattggtgatgaagttgctgcaaagtataaaaaagtgaacaattctcaagatagggagctgtttattgagttttgtcttcatacaatattgtaccagcgggtctctcaaaagtatggaactggatttatgctaaacggagcttatgatatttgaatttgttctaacactagttagtcttttaaattcctatttcaatcaaatggaagtttgatagagtatatagtatgtgcctttgtttatgcgcatgttcctgttactagttgctcttcattgtaaatggcaatctagaatgttcataagttaatctgttcgtgttctggtggaatgttggtagttgctgtaacagtcagtgagtaagaagtttgttgaacaaagttaaatattgtacacataagaatcagaatactctgaatccatatctaagataagaatagaaagtgaaaactcagttttattttcacaaagattttgtctcagattctctctctctctttagaactctattatagattttgttctgttgcagtggtggattccctcctgggctttcagtagctcaagtcaatcgtgttacggggaaacaacaattgcaaagtaatgaaattttactaagaaaggtaagttaatcatgtaatggttttaatattatcttgccatgtgaaggtcgaataatatatgttgttgatgttgtttctttacttctaaaaactgataactccctctactactgctatgtatcttccatttcttctcttgtcagaagaagcactgtctaattcaagaatccctcatctcaatatgatatgctgtttacttttttcccgtagaatttgaagattgttagaaaatgcaggaagagaaataaaatattcagagagagttagagagaatcagaacctgatattattgtgttgttctgaatatactgattatatgatatttatatacaagtcataatactagatggttgtaatacaaataaatgacagctggagctcactttcataacggacatgctaagctagtatagttgttttgataaccaaccaggcaactgttaactactgcaaccgacagagactagagatcaactattttactctgacccataactgactgagactaaagattaactattctactctgacccatatgacctttccaaattttcatttgaatacactagttaacatgtcagtatttccatgtttgaacgcatacaatcatgtcctatttccatgtttgaacgcatacaatcatgtccaatcttgcatttactcagaaagctacttaatctgtcttattttgttctttgttggtgcagttgggtattttgaatgtcattcaagctatggagcttgcctctgagctcgtttatcctttatatattgctgcctctgtagattggtatgttgtagttcccgtgttgctcaaatcatttttaacactttcttattaacttactgattttatatccttttggtgtttcatttgtggatgatcacatgtgttgcttgatcaattaactcaagtgaagagcctgttattaagagaggcgaggagcttctaaagaagaaggccaatggtgctaatttagatgatttaaatctgatcaacagattatttttgctatttaatggtatgttattaatgattgtgttaacatatacagaaatatgtttttgcaaattgattttttcttaattttgttcacgatcatatgcaaataggtgaaagtttctcctgaatcttagatttgagcctgcatgattcttacataaattagcttttaatatttgtctgctcaagagtataattgattcaaatgaggttgttcctaacttcctattatttttcacatttcaattaattaatgtcatgtgtcttctgggcaactttttgtgctcatccttcatgtttgaagtttgaactgtgccctctcggtgatcttcaatgctctattacttgctgctcccatttttcataattaaggctatttcaacacaaaggctaaagggcctatgcattgtttatgctcttgcgtgaagatgtgaaaaatataagaccattctaattcttagttgtccacctaacaacttaagctattaggagagttggtctttaacatacactatatgaggagtcacatcactttcagtcctctttttgtgtgctaacaagtctttctgaaaatgtggagagataaaatgggacaaaaggtaactgcttttgttcatggttatgattttttaaaattatctagagattgtacttcactacatttgtttcctatttttttaatctactatgaaaataataattatagaggatgacatcattgtaatttttgatggtattagtggtttttttctcccaggtcatagcctattgtggtgtgtttatgtttttgatagcaatactagacatttattgtgttatttttatgtccattttgcgtgactttcattttctattttcatagaactcttactatatcttgaaagtgtattcatttttctgccctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctaaaacccaatttggcttttatatatttctctgttttctcttcaatatttatacattattgacgttgaatgtaggtactgttggagttgaacatattgattcagaatcaagagtgagtcccgggagtcctgctttaaaggcaaaattaatgtctatattctgcagatctattgcagcagcaaacaatttcccatccaccttgcagtgcatttttggttgcatttatggtagtttaatattcttttatttaatgattttcagcatatattttctaatattttttcaccctcttcaaaacttgtaggccattttgttgcttaagaattggccaatgtagttaagattttatattcatccatgacacatgcactatagttatgagacttgtccatttgtattaacaatttcatggcttggcctactgtgtctatgatttttgtatatatgatatataatcttacaacttgtattacttttatagttttatttgaggttgtttgattttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttttgttagtttgtggaaatagattctattatgagaaaggagaagataatcaagatatagaaaatgagaatgtgcaaacccttaaagatggaaataaaaaaagtgatgagataatatttcttttgtgataatattgtttctttgatttaaacaatctattcaatgatctcgtgcaaacataaatcatgctaatgaagcccccaatttctctaatcttcaacaatggtatacccttaactaaatcatggaatgaacactgaaggtggaaaatggattataagttataactttgtaccaattatagactatgcaatcttcctttgtaaattttaataacaaataggaattttatatttttattttattgcttataatgcttctttcatattaacaaagtttcttccctttcatataggtttagaaattgcaattttcctttgttgttctaaacaaagttcttatttcattatcaaaatatcaaaatatgagacacacgaaagtgtggatcgataattgggttgtctgtgcagattttattttgctctgtcttttttctactgttctattttgtttttcagtttttatctttgatttgtcatattcttgaatttaatagggaacggtaccacatcaaggttgaagcaattaggaatggaattcactgtttgggtatttaagcatgtaagtgcaatatttcttggcgtttgttttttgtcataaattttacccatagaataaaagtctcttggcctagtaattgtttggaaactagaaactatggttacaacataggacatggatatatcacactggcatagggatataacattttaaaatcatagaacatgctacggttatcataatgcaaagtataaaatttatgtaaaattaacataaaatgacccaaatcttaaatcaaaaaagagaattgatgttttaaaaataagcatgcataattgtagaagtcattgtagatataataaaatgctacaatttatctaataactacggtgttttcatctttattggtgtgaaagtttaaaaataaaagaaaaagttgtacaaatatgtgtctgacacaacacacgaacattaatatcgtgctgaagtgtttatccttccttctttaaaaatgattcaatttaaatgaaaataaagtctactaaaagataatttttttaaaagtggttcagttgaaaatgctgcttgaaatttgcaatgaattgccggtttgaaatgaattttactttggtgaattctatttctatatttagattagcttttttgtatgtggttttacttcactattggctgatgtggcagaaatgtaaaaataaactattggctcaattatgtatgtagttatatattcacattgtgggttaaatttttatggtttcataccagaggtagaatggataatgttgctagacataaaaaccatttatatgctttcgcccaacagtttaagctttttgggattgttgattcgtgcgttggtattggagctcctatgaccttgtggtctagagttcaagccttgttgtccctgttcttctaaattaaagttaaattttagcatagggtagagcaggtgcattgttcatgtttaagcccaataggctcttgcattaggtgggatttgagattgttggttcatgacctatatattcttgttaaaatattgtaaatgaaccttttttttttaaaggcatatttgtacatgaatgttaacttcaccaagatataaaaggtcttatcctggctttaaatctttgtttttcttttgattgaattattttgcttaagaatgccacctctatatgatgaatcgacttaaagatcaactaccacatatacctagtaagaatttaagatgcattgcaaatgatgtcatgtcctcctttgtcccatatatatgtatactttggcagttgcatgttttaccatgattttttgttttttactgaagtagtataacttattgtttccttagcatctttaatatctgtaactggaaatgcaggcaaaaattgatcagcttaagttaatgggtcctgttattttgagtggaattatgaaatccctcgacaactatccaagttcagaagcaggtttgctaaagacttgaaagttctttttaatgttatttgaataaaattagtttattttacatttaattttaagtattgactcagatgccagtgctcgggaggtcaaaacttatgcatttcaggcaattggattaattgcacagcgcctgcctcacctcttcaggttccaatctctttatttctcatggtcataattttagccatttttgcatatttcccccccttttaattggtacttatttgtgcggatgggaccaaaaatatgtttgaaagtgctgaatggtgcagaacatttgaaataaagtaatgaacaatttataatatatttttaggaaggttaaaaatgaggctgatagcccttgtgccttcaaaggagattgacaattgtgccatttaatgtactaaaataaaacatgaaaacaagtttagcaaaaaaaaaaaaaaaaaactatttacttgttttctttgtcaaacttacctttaacagtgttctatggatcgacataccaagcctacactgctctgagaactgaagaaaatatacatattactttacaacagaagaggcaagcatgtaaaattgaaagaatgattcaaactaaactgtgaaccccattttgtgggaaagtagaataatgggtattaggaagaaatgaaagcaatgaatttcaatagagaaaatacaaagagtgaaagaggagtttgggtgatgtattgtaggggaagcttttctcagatggaacaaagagaagaaagaggaagctttctagagaaagtgagttggaatttgatggagtgtaaaaatgtgtgggatatgaaagcaacttctccctgttagctcattggatttttaaataaaagcattgagtaaatgcttaaagttataggaaaaataataatggttgagggctgtagttatccatccagtttggtaacttagttcctccatagcttgttatttcattctttcaatatatgtttcaaaatctaactattcataagttatcattagatctttctgcaatgcgattgtgaactctcttgtttggacagtgatacactatagaattaataattctcactgttgtagacttgtaggcatcacaaggctctttctcctgatctgtgtattacattatgagatagagttgtcttctttgtttccttgagactgtctgtaaatgttttctttagagatgtttcttctatggtttcaaaaagggattggatagctctctatttaattatttcttttttatcccttttaaatttgcattgttttaggatggtttgctattgattttttattttattttattttatgtatttcccttttttcaggtaacaaataattctctttaataaaagaaaatttcttttcatgagttaggtcctttctgagttctattaagtagttactaatttagctgctccctgttcttccagggaaaagattgacattgctgctcgtctttttcatgccttgaaagatgaatcccagtctcttcgatttgttgttcaagaggcaactatatctcttgcttcagcatacaaagtatgtacctctttctgccacttgtgtaaatctatttttcattaatattctcagtcatggaaaacgtattgagtatatgactatctgatgtgaaagtgaaactagtttgtcaagtttagtcacacagttatgtttacctcacttgcatatccaagatacatcatatcatgacatatagatattttgacaaataaaaagtatacaattgcttcccctattttcaatgcctcaaaattataccctccattttcatgaaattcaaagatgtaaggaaagtaaattgagatgcattgctcattgtactgtaaaattgcttgttgcaccttcacaagtgtatgctataagaaattataagtcattggacacccaaagttgagcccaagattagctgccatgatattcaacataatccatctctttcggaggaaaatgttccatgatttaaccccccttttgatcatcacatgttaattaaaattaatacattatagattggagaactacgatgaaccaatgaacttatgttttaggtaggggtaaacatgggtttgaacaacctgattaacccgacttgattcgaacctaaacaacttggtttgaccaaactcttggttcaattcggatttcaaaagaagcaacttgaacaagtcaagtcaggcaacatgtttatgtttgcaaatccgagaccggacccgacccaagttatgtgtacatgtttattttatttagtatgagacagtgagtcagtgaatgagtgttttcgtattttgtttcacttcgttgcgtgccctaacagcagaagcaaacctgggcgtttccttcttcggcgataaacagcccacgacggttaccaaaccttgcttcgattcctcaattccaagctagggacaatgtcatcagactcaaacatggtcgatcccacacgctccgcccctaattttccctaccaatccgctacgctaccaccattgtccattgacgacaagaatcagaaggtcggcgagtttgaaggctacttagttcaaagacttgcagacggttccatctccagatatcccaacatgctgctgtttgtttcttttctttctttgtttctttcaataccagttctcagttgactccatccgtggaaattccttacgctgatggaatacaatgcagtcgatgcaaattctgtttatttattttccgatttgtgactgttctgtgaatctgtgaccgtctctttcatttccccaatattccaatttaatgttttctgatgggtaacctgagaactgatttggtttgtgacccgaagttagccaagtcggatcaattcaggttgggaccggaaaatggtaacaacctgaaccgacttgacctgaaatccttgaagcaattcagttttagttcgagaagacgaaacccaaaccaaattgacccatgttcaccgctagttttaggtattgttttgacttttagttttgatctgaatgaattccttgtccttataattattttctttccttctaacagagtcttatttagccaaatataattaaataatactaacaataatcatttcaacgtattgatatttccctattgtctcttgcactaattcaaggaggtatgaaacatattacttggaaaaattacgtcatttattcaaattaggaaagctatatagtaaatttatggttgcattggtgttatgttggttgagttgaattcttttatttcataaaattagagggtagaaacacaattttcttgagactccttttattttaagggctatattttttaactctttcaccaacttaatgtcataactttgaaattctctcaaactttaggactttaggtgttgggctaaacataatattgtgactctgtttacaaacttcagatcatgatctattttggacttttggttgatttaggatttgaccctcttttctattgcacattttttattgactgaagtacttaactgtcttgtgtatcagggagccccattagccgtgttacaagatttggagatgcttctgctaaaaaattctcaagtggtatgacaaaacatgctgactttccccttgtatctaggagactgtatgcagatatattaccttgctgagcaagttcatggcacagttgtattcgtatttgttccagttgtgttgaaagttacataaataacaaacctactccactttcttagttgcctagatttattgtaacttagggaacaaagttagaattattcgcctaattattctttgttgtaaattgctgcttctatttatttttcctatgtattattctgtatctgtatatatatccctaggatgagtgtgtatgtcaatcaagcaattttactcagattttcttatagagaagctaatatgagacaacttctacaaattgacttgtgcataaactaattttagcttatgaagaaactcatttcatttttcttcttttaaaagtgcttctggagaagtttatctaaacatgccctttaagaagctagaaaaactacaggatgccaaatgaactcaatagaagattcttgcatttctctccaaccaaatacaccgaagaactgcagcctgagaacaccacatagctttttggcatctttgctataaccaaatcctctgaaattgttactattataattattttattgcaatttttagctttattttgttatttttccccctccaaacaattgattttccttttatttcttatttccatgtagtaatatccttttttatctaattaaaatttaaaggacatatggtttgaacagtaacatgctgcatggtgatgacaggaggaaagtgaagtacgattttgtgctgtaagatgggcaacatctttgtttgatcttcaacattgtccaagtcgttttatttgtatgcttggagcatcagatgctaaattagatatcaggtattttacaaattcctttagcaatgaactgacatgctatgatgagttaaagcatgtagtcttcttaaagggatttctcttacagatattttgagcaaatgtttagctttgcttggtgtttttctttgttttttgtgtttttccttttactttatcttcccaactgattttcttattttatcaacaaaagaggaaaaaaaaagaagctctccaggtcaatttattaagcatgcccttcattaaaagcttttggataattttccaaaattgttttccaaaggaggtgcaattagataatgaaccctttattacatatgtctttcaatattgcatcaaataactgtttgagcctcttggcaaatcaaatgtcataatttctataaagcatgtacagaacatcataatatgcaaattaaaatgtatgtggcatgcatagttgtagtttttaaagaatattttgtcttgtaaatgtgttaaattttaataaccatctttcttgaatttgtcatgtcctcagattgtatggcttttttaataatcagagactctgattcctgtaatgtgttttttgttgctataaatagttacttttgttccatgttgatgatttttgaacttttttttttctgagttataacacaaaaactttgagttgtaactttagctttataattatttaggtttcttttgtaattaagtgatgatgttttttataacttgaagtcttataaatcatattaggttttgttttctggtttgaaacagagaaatggcacttgaaggtctttgtcttcttaaaagtggaagtgaaattgttggtcttaagtatcccaaactgggtatgatgctggatcacattcttcaacaacagccaaagttgttggagtccagtgaaactagagaacagaaccttctttttccttcaaatacatatgtggccatgattaaatttttattgaagtgctttgagtcagagttggagcagaacaaatccttagaaggatcatctgaatttatttcatcagtgaaggcattctgtttggttctcgagcattctatgtcatttgaaggctctgttgagttgcatgtcaatgcttccaaggcattgcttataattggatcacatatgccagaggtcagttgtaagagctctttgattactttcttgattgtgttccttctgacacatattgttataggtggtagcatcacattttgccctaaaagtttcatggcttaagcaactactaagtcatgtggattgggacactcgtgaatccattgcacgcatacttggtattgtgtcttctgctcttcccatccctgatgttatgtctgaattgacttccttattcagccaaacacacaaatcaaggtttgtatactggtggaactgtaattttttaggtcagtttatgagaattgctgctttttacctgttttatatatgctcatgttgaattaatttattgataggtttgagactcagcatggagctctttgtgcaataggatatctaactgcaaattatttgtctataacacctgtaagtataattttactgctttttttttaattagtaaacggattagaacactataaacaagctttagctgggatcaataggctttaggattttatacttttatggtttaacacaacttttgcataaaatgctagttttatcagtatgatatttgagtcatgtgtaattgtgacttgtgattttgatcttgatcaacatgctgccctttgagctaatgccttttctgaaatatactttgatcagatgaaactgaaatcttaattgttgggtataatcatgtcattgctttcactataaatatatttgaattttgtgtatataaaatgatcttcgcagatgccagaaatacttctccagaatacacttagatgcctggttgatgtagttaattctgaaacttctgcactggctgctgctgcaatgcaagcactaggtcatattggactacgtatttcattacctccacttgatgattctaattcaggtaaactcaagtctaataagctgatgtacttgtttggatttggacctagagttgagctatttgttgatctattataaaggtgtctgattaattctgcagatggaattctgataatgttatctgataaattgagcaagcttctctcgggtgatgacattaaagcaatacagaagattgttatatctattggacatatatgtgtaaaagaaacatcatctactcagctagatatggccctaaatttgattttcagtctctgtcgatctaaggtaattcagcttctccctcctcttttatatcatttgcttattgtcagtgtgattcatgttggattgatgtttactttgatgtttctttgttttttgtctcctgtttcaatttattgctccatctttttttttttccttctttcctttttatgttgtggaaaaactagattttggtttttgggatgccttgatcttgattaaaaacaatttgaagtttttttttttcattttcttttgagctaaaatgtccattaatgttaatctttttccattataagttgcagcgactaaaaattgtcacatttatgtaactgaaatttcaggttgaggatattctcttcgctgctggggaggccctttcttttttgtggggtggtgttcctttcaatgctgacataattctgaaaactaactatacttcactgtcaatggcttcaaattttttgatgggagatttgacctcttctgtatctaagcagagtactaatgaacaaagtgaatatagtggagattatcacgcttctgtgacagatgcaattaccaaaaagctctttgatgttcttttgtatagtagcaggaaagaagagagatgtgctggaactgtttggctagtatcacttataaagtactgcggcaatcatcctactattcagcgaatgcttccagaaattcaggtttgcattaagaaaacaattttggctttgtttaaacttgctgaatttgttaaaggtgctcatatgagtcctttctgaattttattatgatggtgggagtgtgtgtttatctggattccagtttataacctttggtgcccaagcaggagtgcttggtcaaggttgtttgctgggctgaggttcttccatgttaatattctaaattgttgttgtaattgatatggtggagcttttcttgttgtgaaaccacaaaatgtttcctaaacctggttacctgggtattcttataatttattttgggctaattgtgtttttagtctccgaaaaatggtcacctttggtttaattcccaacttttaaaaccataatttttgtctatatttttttaaatacccactaagttagtccctaaagctaacactttagggaatgaaaacttatggttttaaaagttggggactaaaaccaaagatgtccatttttcagggaacagaaacaccattgacccatttgttttatatgatgttcttgacactgtatctattttgtagcagaatcctgtaacttgtaatatttgatttacaattatcatgtaaatgcaggaagctttttctcaccttcttgctgaacaaaatgaactcacgcaagagttggcttctcagggtatgagtattgtgtatgacattggtgatgaatctatgaaaaagaatttggtgaatgcactggtaaataccttgactgggtcagggaaacggaaaagagtcatcaaagtaagttgttagtctagtcatattttataaaaaaaaattgtttttggtgggataaggattgatggtttattattttttgctctcttccgttaattttgttgtttaaaattacattcctgaagttttgttgtgcagcttgttgaagacactgaagtatttacggatggagctcttggggaaagtgctagtggagggaaactgaacacttacaaggagttgtgtagcttggcaaatgagatgggacaaccggacttaatttataagttcatggatttagcaaactatcaagcttctctgaattcaaagaggggtgctgcttttggcttctctaaaatagcaaaacaagcaggggttgttcttaagccatttttacgttctttaattccaaggcttgtacgctaccagtatgatcctgacaaaaatgtgcaggtaagtgccatcactgccagaaaatcatagtggtagagaataacagctgcccccaaccccaagtttctataacggtttaacgctttgttccaataaaaaacagaaaaggaatggatgcacacaagtacaatagcatttgcattgcttctccagttctttatgggttcagttgaaagtcaaaacattaaaaaatgaaacttactttattatcttttgcttcccatttttatttatattctggtaagcctggtgttgaatctaattcttaccaatagcatctccagtttaacccagaaaaactctctacccagttttgatctatgatagaacataatagtactatataattcatgccgttgttttcgaacatcaaaatgtagttttgccgcataaaattgtggtttggttctctattgtgttccatgtaagatttttctttttaaactttcaaaaaaataatgtgcagtttgtatttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgcctttttcaataaacaattcctcttttattaaaaagcaatgttatgcatgatatccaatgagtatatgaattcttattttcagacacttatttcacttgattattgcatttttttctgtttaggatgcaatggtacatatatggaagtcacttgtggatgattcaaagaaaaccatcgatgaaaatttagatctcatcattgatgatttgctagtacaatgtggatccaggctttggcggtcacgtgaggcatcatgtcttgcccttacagacattattcaaggacgaaagtttcatgaggtcattaacatttcttttgtttttcttgagtataaacaagcatacttagttgtcaatgatcaattctattatagaaaagaaatcctcaaaattattgtaatcaactaattacatgtagcaacaaaaaccctagtcactgttatggtgaggcactatctgtaaaaatctgagcaaaattttagctttgttattgttgtgggtttgtgatgtttgtcaaaggagaagaatggtgccagttctggccttctgttttttccttcccatttttgtcgagttgtttaaagctttatgtcggtataaaatatggtttataagtttatttagggggctttcaagtgttgatttgaagagggattagagagctatttatatatgatgaacaattctgtttggtatgttttgtttgatctaggaggatttttgttctcgttgtattccttttctatgaaatttcctttaaagaaaccagttagtcaatattcctctttttagctgtaatctaattgttgcttatgcttgaaaaattaagcagagccagttatgtatcttatgtgtgctaataaagtctgatttgcataaaatgtatttacgagagaaagaccatattatgctgaaaggagagttaaaaagtgaaaaagaactggcaatgttaatgatatactagaacctgagcactggttgattttgatatatctgaagctgtggagcatatcagcatgtctttattcttgtttgtgtgtttttatttcatcttgcaccacccacaggttgggaagcatttaaagagattatggtctggaacattttgtgtaatggatgacataaaggaaactgttagaatttctggtgaaaaattatgccgtgctgtaacttccttgacaacaaggctctgtgatgtctctctaactgatatgtcagatgcgcacaaagcaatggatattgttttgccttttttgcttgcagaaggtatactaagtaaagttgatagtgttcgcaaggcatcaattgcagttgttatgaagcttacaaaggttaggaatgtcttgctatgcggtagcttttcaacttgtgtcatacactcactttccttttgtttctctcttatctttctgcctccggattgtaaatatttgtgtattcacatctcaagagttgtttgtagttcaaatcttattgaactttgtagggatgtatatgttttcttggctctagtgttttattatctttccttttgttttttgttttttattatcatgggatgtatatgttttctttgtgcattattccaatgatttttcaggtgttatttttttggacacttagatgggaggtccatcacttactgatgttttgttttttggtactatgttctttgtttaatcgtttaaggagtacagcttatcctattctcttgtacttatatttttcaaacttctttcccaaaaataaaaaaactaattagaataccaaatgtttgtagaatgtatttcctggtaagcatgattagtgctaacctgcacatataatacattacaaagtttaaatagcattcacagttttggatgtgtttgttgtctctttttgttttagttatttagtttatacgtcatgaaatttgtggtttgtctttgactttgtttatctgattgtgattgtgtaagattaatgattgattattatggaagtaaactataacagtgctgttattctgctgttaaatctgagtgtgtctccttttagcatgctggaactgcaattcgaccacatatgtctgatttagtgtgctgcatgcttgaaagtttatcaagcctagaagatcaatcactcaattatgtcgaggtttggttgaatgatatattcaattcttgcacaaattcaccattaattcttgtttattcatatgttaactttttatgtttttctttttatcagcttcatgcagcaaatgttggaatacagtcagaaaagcttgaaagtttgagaatctccatagccaaaggctctcctatgtgggagactctggattcatgcataaaagttgttgatgcagaatcattgaacacattgatcccacggcttgctcatttagtgcgatctggagtgggccttaacactaggtctgttattaacttattatcacatttcatgcattttcttttgcattgtcttcctgcttgaactgtcttgagtcattttgttattgaattttcccttgaaaatttaaggagcttatgttggttcaaatagggcgagtttagtagaaaaagcatgtaggattagtgacgataaatagatggttgatatttgcagtgttttctgtattaatatattgtcatccttatcacgctgatgctccagctttcttgttttaataaaaaaaattacattcctttgcttttcctcttccttctttttgggaatattcttccctataattagttattctttctgtgcttgtgcagggttggtgttgctaatttcattaccttgttgcttgaaagtgttggtgttgacatcaagccatacgcaaatatgttggtgagattgttgtttccagttgttaaggaggaaaaaagtactgctgcgaaacgtgcctttgcaagtgcctgtgctaaagtcttaaagtatataccagcctctcaagcacaaaaacttattgaagatactacagctttgcatgctggtgacaagaattctcaaattgcatgtgcatttctcttgaagagctattcatctatggcagcagatgttgttggtggatatcacgccgttatcattccagttgttttcctttcaaggtcatgaacattcttattttttctgatgtgatttattatgtggatattttataaaaatccgatatttcgatattatatcaagccaaaatcataaatttaagcagaagcttttgccattggctgccagtcactatcatttagaatgatttgtttgttgtttattattgtacagagtgttgcagtattcaactgcactctcagttaaatcagttagttaggaattagttaggagttagttttatgttgagttagttagtcataattatctaagcctataaatactgtttgtaactcaaagttcagtggccaataatcattttcacttctttctaaaatttctctctctcaaaatatcttctactatgatctgttagaactcttttattgttcttggagaacattgggtgattcctttacatttaagtagatgtggtcttggagttcattatgatgcttatgtaacaactttatttgtctgttaattttgtggaatatgcaggatttgtttcgttcttttgtttttcctataatttctcttgtaacaattcaaaggatgtactaatctctttactgttgcattctcatcagtttcagaaattatttcatgctccattaaaatttaaaaagaagaatcttaagaatgtattttgcaaatatccaagtctaggtcactttagaggttctgagtaccattaccatgtttagtaatcacattttgctgaaataacatctaatcttggtaatggtggctactgagaaatttatgtaatcacattttgctatttcggtacttctggtgcctttcattagtatatataattttttgctgacaaaaaaaaaaaccatgtttttgtcccatttagtctggttatagtatcctttgttttagtaaattattagtatggagaacaccaagttctttcagtttcattgaccaactctcttaaaagtttgaagttaggtggagggctgggaatagttttatatttctcacacatccccctcttgtgaaagatctttggcttagttcatggaaaaagcacaggccaaagacatcttgtctctaattataatttaattcgaagaatgttcacatcagcctcaaggacccacacttgctaaaagcttaagctcttaggtggggccaataatggattttatatttaatgttggaaaattatgtatattgtttttagacatttgattctgaattttaaaggtactcaaggtaaactgtgtttattgaatgatgttcatataacaaactaaacttcatattgaataatgaaagtatttcttattttacatgaactaaaaaatgtcatgcagatttgaagatgataaaaatgtctccagcctatttgaggaactatgggaagaatacacaagtggggagcgaatcactctccacttgtacttaggagaaattgtttttcttatatgtgagggcatgtcatcatcatcatgggcaagtaaaagaaaagttagtcttgccttcttttctgcattttatattattttgatatagcctcatagaagctcggtgatttcatgattcgtgtataaatgtttgcttattttctgctgttttgcgtgcagtctgcagaggctatatgcaggcttagtgaagttttgggtgaatctctttcttctcaccatgaggttttgcttcagtctctcatgaaggaaattcctggtcggctatgggaggtaaagtaatgaattttgctttggttgagaatagtgccacttaaagtttttacatgtggcaggaaaaattattacaaaaaatcaatcaaagacaaattgctcaagtttcatgtgcttgttttgtcttattacatatggcagggtaaagacatgctattgctagcagtaggtgctctatgtacatcctgccataaagcaattttggctcaaggttcctcatcttccattgccattctgaatttggtatcatctgcatgcaccagaaaggggaaaaagtatcgtgaagcagcactttcctctcttgaacaggttagtaatttatagtgggtgctggttagtaattttgggaaagttttctcccttagggtaagtattcaattgaaaagcaactagcattcttgctttttgaaaaccaactccatctccattgagacaagtgaagatatgtacattattgtatgttgtgtataactaacatgataattcattgttaatgttaatcagttatgaaatgaattgataatggcctattttttgtagaactgtctagagaaaagaatgagtaaatgtacgaaagaaatttgcctgtactagaaattggcaaaagttatttagaattgagatataagaccccttcaggtttactttaccccttgtataagtagcttcgcaaggttgtgcctgcttgtactggttgttgagaacgtcatcaaatattcaagcaaaagataaattataataaaaaagggagaaaagtggcaacttaatctataacaagttatggaccaaaagtattagaaactatctaattctataagagtacagaacagtgacgtcccaaataagtattggactctataatgagtttattttttgtatgtttccaggttataaaagccttggggaatccagagttctttaatatggtttttcccttgttgtttgatctatgcaattcagagcccctaaagtccgggcaagcacctttggccagtgatgctgctggatcaggttatgacaaattctggatcttcatttatatcttgcaacagtttttgttccgcaaatgagactgtatggtcaccaatgaaacatttaatgcagtttttgaggtgaagtttctcatgctaagggcccgtttggggtggttttttttggtttttggttttcaaatgcaatttccaaaacaaaacacgtttgacaaaaatggaactgagatgatttttaactcaatttcaaactttctcattcattttcaaaaccaagaaaaacggatttatgaatttggtctttagttttaaatatgtacattctccttacattttacaatgtgacccttcccataccaccacccccaccatagccgccatcactactggcactggcactgccaccacaacaacctccatgaccacgggcaccaccatcgccaaccatgactaccgacattgccaccgccgttgttgtcaatgtcgtagtcaccgtcgccaccacacaaatacacccttaaactaattttaataggatcggaaactttcaaaatgagtttattttgaaactaaaaattagaataaaaaaactaaaactgaaaactgatttttttttttttaattttgaaacttacaactaaaaatcaccccaaaacggagcctaagtttgtttagtttggtgctgattaaacaaatagttaaaagagaattgtttcttgtatgatattgttaaaatgtcccacattggttaggaatatggctagaagccggaattgagcaatcctctccccttaagctaactttttgggattgaattaaacctattccatttctaatatattctgtatgtagtagtgttggagaataagttccatcattgaaaataggacacaaagtgaagcattttttattgttttttattttcattttttgctttcactttttcctatacaaatttttgaaaatagaaaacgttttctcaaaccaaacatgaccttagtatctagggacttgatgaaatggatgattctccttgtttgtgttactgttcaatacttcaatggctatttcaaatggccagccacttgactaatttgttctttccttgttacattgattcctgtcggagctgctcagtgctactgactacaagcattttcaatggctatttcaaatggccagccacttgaataatttgttctttccttgttacatcgattcctgttggagctgctcagtgctactgattacaagcattttgacatacacttttttttttttttttttttgcagagttgaacagtgttgatgagatttctgttccacataacaaaatagttgactgtttaacctcttgtatccatgtggcacatataaatgatattcttgaaaagcaaaagggcttagcgcacatgtatacagcattcttgttacctgaacataaatggactggtattctttatggctcatttttcatttttcgaagtcccttccatttttttctattaatcttaattaagaaagctttctttgtgcagtcaaaactgcagcttttgtatccatcagagaactttgctcaaggcttcacaatgttgtgaaggactcccagggaagtaacgaacttgctggagcaacttcctttgttcaggaggtaatggaggcttactttcagttggacttctaataacttcaattcttgaatgatctaaaatcaactttatttttcttcagatatttcattctctggcaccaaaaatactacattgcataagcacaataaaaattgcccaggtacgtcactgtcttgttttttttttttttttttttattaacaaatgttagttgttagtttttgttacaatgttagtggaagggattcgaatccacaatctcttctttttcccttttcctttcaaccaccaaaccaaccctataactccacgtcactgtcttgtttggttgaacattattcatcagttagattcccctgccttatagaagtcaaaaaccctgaaaaggtaatcagcatttgtttggtattaatttttaagtttgtaaaatcttatatctgaacgctaggcacattagttgacttcaatagacaacacaactgattataatgccatgagtcagaagtgcaatttaaactgggaatcatgcatattttcattgcattcctttaaatatttgttaaacgttatttatgaaatgtttactgaaacatgttccaaaaatttgatctgtgtttgtatatgtactaatatatttgccatcagtttgtatgcaaacgagtgtctttctttttctcatgtagaacttataaggttggagtggtccagacaggtgaataaaagcccagcaatctattttagtttcacccaatctttaatactaaatgcaacaaatactaagtgttaaaaaattactacacacattacatttggttgccatatctagcaaaagtggacttgggaataaaactgaagtaaaataatatttttgggaatactttaaaattcaaaatataacgaacaaaactgacagaattgccaaaatttagggactagacttgtaaactttttctttgcgtgttcatctttaacaagtggtgattctttcagtaatctaattggttgctgataattttatttcatattctgcatttcttgtgcccaaaatcaggttcatgtttcagcttcagaatgtctactggaagtcatgaaccttgccatggacgtcccttcagttggcaccatcaatgaaggattcaaggacgagctgcttcatcagtacgagatagagaagaacgaaggagcaaagtcaatattaaaaaagtgtgtcaacattcttcaagactggaaatagtaaattgtacgagctatagctgtaaccctcatttatgaaattttgggtggatgaaacatttactatgtatagctcgtgcttggtgtagtaggtccacatatagcgatgacaaaaaaactagtacccttaggtgaaatccgttacggattgaatttttaacacgatgagggtggatagcaagtatctatattttatgaatattcataatttgaaattacttaaatgtctttcattatattttaaaattatctagttttttttttttttttgtttttttacctgactcgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattattaattttaattacataaaatcgagtatttgttttatggaattttcttatatttttaggaatgctatttttaggagtataagatgagaatattatttttggtttttttaaaaaaatatgtttattatattttaatattcatgagaataatttttaaaatttaaaataatttaaataaaaattagtattttttataacaaaattaaaagtaatttaaataaaaaagaaagtcacttgtgtattagacaaatatcagtttcccatcttctagtacgaatataaatattagaaaacatggtaaaagggaaattatagctttctcagacaataataatacctaaaaatactttttaaaaacttgtgacatagaaatatacattctcgttttcattttcataatttgaggataaaattatacatttaatttagtaaaattcattcagactgtaatataccaataattagattaagtaaaaaaatacaaaaaataaagttagatgaagtaatttattaaagatattcttttttaccccgtcaaatcaaattataatatatacacacttaaaagaaaaactgaatttattaaaaactaaaaacaataattacagtgattgcgtttctccgttctcagaaggttttggtcagtgaagtcttctccttcaacaacaacaacaacaacaaggggttgcagtgaacatggatgaagctgaatttcaacgccttctccaactcttccccgttgttcgttctcgggattacactgtacttctgtctttctcctctctctgtgtttagggtttacaacactgccttttccttaattttggatctctattactctgcatctggcttctctgccagttaaagtttcgatttttcagacacccatgttgtgattttcgtaattcacatattgcttctctctgatacaattgtacccttttgcttttatgttggtttaaggtggtagtgttagagtaatgtactgtagtgtctgaattcatgtggaaatttaggtgggtgcaacagactgggttagggtaccataaatatatgagtagggtttagtatgagatattaattaacaaggtcctggcatgaattgggtggattttataagtaaggatgtggtttcagttcatgttgtgaaattgggtaattcacctaggaattgaagttagaggctttggtaggaggtttgagcagtaaggataagattctatggagtgtttgcagatctattgtgtatttgattgaaatggattgattttgtgtttgaggacattcgtctctatgaagttgtcatgggacaaggttgtattcaatttatgattctacctgggtcccttctcatggtttttttaaaggaagtttctcttctaaacgtctggattggaaagctctcctgttttccactttcaagtttcatctttagttgtatttttcttattattatttagtcttttcaatattatttttaggaagatagcttatcctccttcctttgtgtgttctttctcttttcaatttgaacatactgaaatccaaagccatctctgcttgctatggtttgatggatcagtacgataaattaactttttttgttctatgcgtgggttgatgattggaaaatgctagaatgatgttaagggacttgctacttgacctattttagaatttagaggcaaaatcttgacctttcttttctgtatctgggcttcctttgtgctcagtttggattatggagaattccttacagttgctaggattttgcccaggaagttgtcagaaccaattattatctcatcttgttttgatttttatttgattcaaagaagattggaataatttcccatgtttagtccatttacatttgtagtatgcacaacattggcattttatatgaatcaattggttttctctaccttaaatgcttttacacatttggaggactggcatgtgtattagtttctgaacttgagatactgatgcccacagcatactctgaaactatacatgatgcaaaatccaagatttttatttcttagcttaaataatttacaaaattctatatttgtgaatgcattgaagtaccaaattggcaactgttaaatttcaggcagaagcagcatcatccagacaaattgcatctgggtcagcacagaatgaggtggtaatgctgaacttgaatatgttgtatgcattgatgtctgcatatatatttattgttagctaacaaatttgtctctgcaggtaaaggaatggcaagatgcatgggatgaaagggataaggattttgagaagcagggaattaatcaacaaggtaccggggtaccagtatctttgggacttttttttatcaacttcagttttcgagaaagcacatcaaagttcatgagttatatggcagtctgattaattatttttgttataactcataagaaacagaattatgcttttgaaattaatgctatgcttgtgtgaattcttcaaatctacagattcattttggagcaagctaaagtcggaggctgctaggaaggtattctgaaatttacctattattaaatgcatactaattttgttttagaattagcattgtagcacgttattggaaatttgtttacacccttgtttaagtccttcaaaagtttgaatatagtaggccttttaatctcaaatggtgaaattttaattgaaaactaatggcaatggctagatggtttgacttaatcttccataagaagagtttgacgtatggagggataccttggtttccatttatgcatcagttgcttattattttctttgttgattaaacccaaattctctattttcccatattattgaaaattattttttttatttctagttgcatatggtatgtcaataaatcagttgttttgcatcattgcttccttcccttggcaacagtgaccttttacttgatttccatgcccagttgaaattttcatttaatggacctttattttgccgagttttttttgggtactttattatgattattttgtaaagatgaggagagaagcattctctaatctaatgtaatggaaaatgttttttttttttgttataattgagaaatattcttattaatatttctgtgctagaataggtttttcctctctattgcattttctttttcgtaaacctgtttgtgagagctgtagttacatcttaaattaaactattacaagctcttcagacagtagtgacaaaagagataaggtggttatgttatgtctttagtatttctgctgtataagcatactttgatggggatgttattgaggatccatgacatttacctgtgattattaaacaagtatttaagtatcctttgaatgagacacagctcattggttctaatcttccaacaggtgggtccagaagaagcggagagattttgcaaggcgttccaacaaatccataagaaactggtatgtgcaaaataattgtgatttaagtcattgttccaacaaatatattatgaaagatatattttatacaacttggtatcttcttggaaagcattttttgtgaaattgtctaaaaaagttatgcctgaaaagtattattttctatgaaaatggaattttctatatttttaggcgagtctttcctgaaggattgtctttcattgattaggaatataattttgtgaactgcagagacttaagaacattatacatgttttgcaacagaatatagaaaaataagaaaattaacatgtttctaatgaaatactacatataattagaagctgagtttccttgttagtattgcatttgtcgaaattttattttcttgttttattttatgttttccattatattttaggtcaatgaagagttgagtttagatgctgctcgaagcttcttaaaatcatcctagagttctaaagaatcacgcatgctttcgacatttcttatgattaaacaatcagccataaattctttgtactgtatcaaagtattttataatttaatatctgcgacattttgatttgtacttatttatttttattgtattattaagaactagtattcttcccccattaaccccacccctttttttcttcatttctattgtttgaacttcattgtttttatttgcctataagcggtgattgtgatcgtatcagataaagtctgttacagttataataataataataataataataataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatataaattagcctttttaagataaaaaatcttaatatttactagattattttaccttgggatcattttttaagcggtaaatagactagttatatcatgcaagtgatgatgaataagcattattaaataataaccatactgatttgggaaactagttaaactcttagcgaccatttgttgtattaataatttaatatgttcacacttttacgagagagttgattgtttattttaatatatctattatctacaatgcctgtgttgtccttatacccgaggaagataatatttcaactgaaaactcaagatagttgaggctttcagtagcttagtaggacaggtattaggtgattgatgagaatacaagaataaatttgactagacatttaaaatggattgttaatattaaatttaattataatgattttaaccatttatgtataattataagattaacacttttcatttcctatcatttcattaatatgccactatgtcatgctagttgtatatcttcttttgcgtttattggtaagtcacttttaagttcggttgtcttggttaaatcatgctagcagttgataggtaagtgtcaccaagaaacacgacatttccttctatacctggttatccagaaaaaaaaaatgcccggtttctatgttttagtttattttatcttttgaataagttctctgttttattttcagatgatattgttctataataattacaaaataatgctattctgattaaaattaatattaccaaaagttatgaatcgccacgcatgctcgctgctacgtaaaacacaaatttggcagcctctcatgtctcatttatgatttatccaataatgtatgggattttagttctgtaataaaggtttaatgttactttttgatcaattatgttttggagttgttctgttttaatatattaaattttaaaagtttcattttagtcctttatatttttaaaatgtataattttgatcatttttttcattttttcgttaaaaatgttattgttatgttaatttttaaattttaaaatggtttaatgtcattttgggtccattatgacacattatgttttaaaagcttcattttaatcttttatgttttcaaaatgtatcgctttggtctttttttcaattttttgttagaaacttattgagtcatattttaaattttagaatagttaagttaatatagtgacaactaaaaatcgttactatcttttttatttaaaaattaaaaatcaataaataaagaaaaaatggatctgaaatcacaaataacaacatttaatctcatattattattaatattattctcttcattcaatttaatcatttaataatgataataatttcattcaccaattattctcaatcacaatggataagagctcattctccttccgccgcttcgtctctcgcccttgttgccctctctattgcaacctccctacatggttggaatattcagtgatttcaatgagattatatatttacgttgttcagtctatgtagtgttgcattttttacctttttatatcagaaaaaagttagaggagatgattatttttttagttgtttatttttaaaaataaaataatgatagtagtaatttttagtcaccactatgtaaaaattattattttaaaaggttcaatgttagttttagtccattatattttgtagttgtttcgattcgatacattaagttttaaaagttttattttaattatttatgtttttgaaatatatcattttagtctttttaaaatttaaatgttaatagaattctaacctttctatcataatattgaaaaattatcaaaatcatacatttcaaaaatataaaaaaccataatgaaaattttataacttaatatattaaaagaaaacaattgtaaaatataatgggctaaaattcacattaagcctaatatttataaagtagcatgcatgatgcatctttcaatgactatcgctccttgcaacaatgttcacacgtaccacgcatctttcaatgtatctttcacagcctctatgatagttcaattcataaagtaattaaataccacgacgactaaaattgaatttgatttaaagtgagatatttgttgtaagttgcatttggcataaatgagtgttgagcttgagctttgctctggtctgaagcttcatctttattaatggtttagttggtggttgagcacctgtcttggtcgcaccgaccttacgccctccctctctttttgttttttgcgtacaaatacaaaatctgaaaagcattaaacatttccaaattatggaaaggacactcatcatactaaaacaaataatttttcatttgtcagatattacttctttcgttctatattatatgatgttttaataaaaaattgtttcaaaatacatatcgttttacaaaactaatatatcattgaatgtttttttaacactactcttaatcaatatttagtgagagtagtgtataataagagtaaatgagtaattaattagaaaaataaatgatatattaagaaattatctaatattttcaaaaaaaaattaacaaataaataacattccttaattattgtatcaaaaccttgaacatcatgtaaaagtgtagcaaaggaagtattaaaaagatgaataataacgagtgtctaagaacataaaatataaattttttattgggatgtgaaattaatactccaacctaatttcaaatgctaaccggtgccttggaacatatttgtaaagagttacatagttttttcagttcaattatatactgttgcgaaagtcttaggatcgagcaaccaacggattgcatgattgggttgttctccaatgcgtctgcttcacttttacgtgtgttgatccctgaattattggccacttcacacgtattttttgaaaccacacagtttgctattgtcataactatagacattgcgtattcattcaagatacttcaaataatatttagttgaacttccgatcatactaagacaaggtgatgataaaaagtttttggaaaatagtactaagttatttaacattattgaattttctagtatctatctgaattataagttgatggtgtctagggtggaccacttttttaagtggtctattatgtatcataatttataatcattagatttagttaaagtgtaaaatgttatcatagattttttctatcgaatcatctccttcttcccttcctacattacctccttttttcatggctatcgctgccatcacgctccattatcgtcgaatccccttatatcatcggtcaacgacttccttcaaagatataaattgtggtgcatgatggaccatttataaaagtgatccaccctagacatcatcttataagttagtataagttataactagagtgattttcaactaaggaattaacagtttacattaactccatgtttaaattaaattgatataaattagagtttaatatgtatgtactaatagtataaaatagttttacactgttatctaattacacatttccgtttgaattactttaagataattattttaaaagttaacaaatttatcatacattgtgagttatgattgaatgactgtgtaaaattttggtttaaatgcaattttggttttcttattttgttcaatatacaatattggtttctttattttaaaattgagacatttggttctcctattttaaaaaattcataattttagtcaaatcttcaactttgtctacgttaatttcttttattttggtctaattgaattctagacctaatatattcatttaaaataccatcaaaaaataatttaataaatcggattgtaagaaataaaagtagaaaaaattaaatattaaaccaaaattaatagacaaatcaaaattactaattgtgtaaaatagttagaataaaattatatttaaacctacaatttttcacaccctcaaagcatagttttttctctataaatgactctttcttttcaagttcaacgcaactctttgttgtattaacacctatgtttattttgaagtgtcactcacctaactagtcacctatctaccaactgaaaaccagttcctctttctctgtctttattgaattcaaattatcaaacaaaaagtcaatgaccttttccttccctttgttcctactcttcttcttcatctaccccctccacttcataccccttcctagttaattcctctttccattttctccaatttctagggtttcctcaactcttttcctttttccaggtctgtctgcttcttccaattctctattttctttcctcttaaaggaacttgcccaccaaagtctcaaattcaaataggaaaaaaaatagaattttctttttctgcactcttcattgagtatgattgttttccattgagtgcctttttgctttaagtttatttatttatttatttttatggagcttggtttcaagtttctacagtgagttccctttttgtttttctagtcaattgtgttcagcagcaatttgaaatcccaaaggcacaatttatctttatgatcttaaaagggctacattttctcatttgatacaatgcttccagataaaaaaaggctttgatttgatgttgagatgagatactcagaacagaacaagcaatttttttatgaccttatggctgatgaattatatgtgattgatcacttttttgactggctatccttatttgagttggtggacaatgggggaatgaaaatcacttcacacatgctttaatcaacacaaatgcggaaaggttgtaagtggaatgcagctcctttacattccaaccacaaatcctggccctattacagcacgaaagcaagttggaagttattttttgccccctacaaagcaacaaggagttcaggattgaaaattaaaacatttctaactccatttcacttccctcctcattttccatttgctcagacaatgtgagcaaccattgtctgtgtatgtttggattcacgttggatgaactagaatctcgttgaaatagtagctaacatgattttaagtgtccactttttcatacaagcattgtctatgcatgtttgaattaacattggaccatctagaattacgttgaaataccagctaacatgattttaagtaaattatcccgtgtttgatttcttgttgagattggatctagaattaattttgagttgaaacaattttacatagcttttaagttgaatcgagaatttatattgagttttactactagtatgcttttatattaaaaacatctaaacataaatcaaatcacttcaaaatcaattatgtaaatgttcacccaaactcactgaaatcaattgcaactaattatgattcttctttcactgttttttatatgacttggcatcatctgtggaaaatgaaatttataaaaggcaactaatttatcttgcaattttaacacaagagtataacctcccattgaatatcattatgtgaagataaatagaagcatgatgtgcagatgaaaataggcctctcattcgatgcacagtacttactctctcacatcttttgctagctccctttaacccaaccaattcgccatgtcaagtttggaggaaccacttggtcttgacaatttaccaagcatgaataccattgataggattcagaggttctcatttggttcttgccgtcctagagtagataacttgggcatgggaaactgctggattgaaggacgaagttgcagcacatctaatagctgcaagtgagtcaagtattgcaacttaagttagagacttgatacactttattgatctatcattcaaattcaacctcctttttccctcttttatgttctaatcactgttgttgtatattttttaatctgttacctcctactatgtccgtaatatctttctatctctgtgcagtgaagatgatgaagagtatacagcagagacatttccatggaaaagacaaacaagagacttatcccgagacgactccttcagtcaaaagtctctgaccaaagggaggaagtcaatgaaatttggaatgattgatgattcattctctgattgccaaagcagtccaaaatgccataccaaagctttgcaaggtttggattataaggtaattcagtggctgcataatcttcaatactctgttcaagttttttcagctactaacttagctatctacaccttgcctcctcgtgtttccaattaagtaatatattttaaactttctattgtctgtttattttatcacatttctttgtctagtaattagcatgttttcaatttttaattggataatggctatgatgcagtttctgaatagtataccaaagtttgtaaagatagtagaagttggtccaagggatggattacaaaatgagaagaacattgtgcctacatctgtgaagattgaattgattcatagactagcttccaccgggttatctgttattgaggctacaagctttgtatctcccaaatgggtcccacaggtattataatggctttaccttatttgttgtaacttgacattgatgatttttaagtgatgggtagagtaaaatttctccaagttgcttgtatctgacattagttctcaatctcatggatcaactggtgtttactatggatgcttttgaatggctactatcattggataaaatccaatccatttatagaattctgaatgacttcaacagttgttatccttatgcattccatctgattttaaataataatgtttctttgtcttatagttggctgatgcaaaggatgtaatgcaagcagtacatgacttgagaggcatcagattaccagttctgacccctaatttaaaggtagaataatctagataaccataaataggcagtcatacattcagatctctgacctgttacattcatagggttttgaagctgcaatggctgctggtgccagagaagttgctatttttgcatcagcttctgaatcgttttcaaaatcaaacattaactgtagcatcgaagagagccttattcgtttccgagctgttactcgtgctgctaaacaactctcaattcctgttcgagggtacgccttttattttctttttaattattttaagattacatcaaataactgtctgcttcaatatctgtattgggaaagcaatacctttcacaaagtggccaggtcaaggtctagtagttggatgcatgaaagtcccaatgattgatgttgttaattttactgacacactattctgtttctattccataggtatgtatcatgtgttgctggatgcccagtggaaggaccaatccctccctcaaaagtggcatatgttgctaaagagttatatgatatgggttgctttgaaatctcccttggtgacacaattggagttggcacaccaggtaacaaatttgatgaattttgaacttctaaagtttaagtgatccatgcttgatacaataattgtggtggtggatttgtttcattttgttggtagacaagattctctattcttgtagaccttttgaagtatgaactttataaggtgaaaatgccaattcttggcagaacttggggatgaatgtaaaactaagtgctttgcattttactatttgtcattggtttctggcatatgatccttgtacttagattgtttcccattcattttgtggtgttcaggaactgtagttcctatgcttttggctgtgatggctgtagttccaatagataagatagctgtccactttcatgacacatatgggcaatcccttccaaatatacttgtgtccctccaagtaagtcatcaactaaatagcttggacttttgacaagcttgtcttttagtgtgtaaaaaattatttcatttttttgtgtgttttgttttggcactcaacaatcattaagggatgttaatttgtatttaaacagatggggattagcacagtggattcctctgttgctggtcttggtgggtgtccatatgctaagggagcttcaggaaatgttgcaactgaagatgttgtttacatgttgaacggccttggtgtcaaaaccaatgttgatcttgaaaaactcatgttggctggggatttcatcagcaaccatttggggaggccatccacttcaaagactgccattgccttgaaccgtgtcacaagtaatgcatccaagatatcatattaactattaagtttaccataaaaatttatatcaatatggcaatatgatcactctacatattatgttcctagttctgcatgctagtagcagaggaataacatgttcactctcatggatgagttttggttttgggaaggaagaaatatagcgagtacaagttgcttatttgaagcttagcttatcattgtacaacaaaagtttttttttcttgcccgaatcaagaatcgtgaattgtaaagataagcaaaatttatttgattagtcataatatttttggaaatatatctaagtttcatggaaataattaagtaacgtgatatttttaccagtgtgattatttaccgcattaaataatctaatgagagtaatctaatatttgtatccaataaaaaactttcagaaagttagatttcacctcgtcatgagaataattttgtggaaaaccaaaaacctagctaaaaaaaattcccagaaaacattctttcttggaatgctatttttaaaatagatatggaaaacaaagattcttaatttaagattttcaaaaaactaaatttatctctaccaaatgaccctaaactgttactctccttcacaacttctttgcttagaatatatttaatgatttcatgatttgattgttgtatttggtgtttgttggagtgttaattataacttagttgggatcgcttcaactagtttaaccttgctagctccttttttgcccaaaagaatgtttataatacataagtttaatttagcattgggaaataacaaggaaaaatcgggggaatctaatggaaatgagaaaattttacatgatatgtaaagtttcgttataataattattttaaaagttttattaatatgattttaattgataaaaatcttttatactcgcagtatatagaaattaatctcaaataaaatttcaacacgggttcttttaattactatttataaaggaattcaaaatattttcttatcaaaacaagttactgaagaattgaacccgaaaatatttcgtcatgttgaaaatattttcaacttagaacaaaattctttctcgtgaaaagttcttgtaattttgattaaaaaactgtaaccagaaaactcttatggattgctatttattatttattttatgtattttttctttttagttttggttttagtttttcataaattatttttgttgattttttttagaaatttatttttaaacaatatctattactattatttagtgatgatgttaaatacattttaaaatactatatcaacaaccacagacttttaaactttataagaaacaaaaatataaattgaaagactaaaataaaacgcacgatatatgcaagagagtaacaaatagtagtattaaatctatctttttcataaattttacccaatcatgtgcatgactatgggtgtgttttgaacaatattctaatatataatcaacaaactcatttttctgggtcgagattttgaacacaaaatggaaggacttgttgaaagtaattaaaagatttaataaaaataaaataactttccacagcctggaatagaatcaagaaattcaacatcagaattttccaaggtttgctactgcggatgttagaacttgcaaaatttatatatatgcaatgtgctaaccaaagttgatgccaggattaacaaattgattaattatgtttttgtccttatatatttttaattttgtttttaatctctaaataaaatattttgtgtttttcttcttatacttttcctttattaattcacataacaatgttttttgatgatgtaacataatttgtcacatcatcagagtttaacaaaataattatatgtaactttttagtaaattatatttttaattattaactagtctgacatcatcagcagatatctaaacaaatgaaagattaaaaatataatttatcaaaatattacgtattatcctattaaatttttttattacttaacaaattactaagttgttgatgtggatgttacttcattaaaaatcagttttgtgtgatagtagagactaaaaatgtttaacagaaaaaaaaatatagggatcaaaattgctaaaaaattgtttagagactattattattattattattattattattattattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactgatccatgtgatatataagtctcgtaagatatgctaggtcattttccgtgtaaactaagataacaaaactaaaaagatagaattcaaagagccgttgaattcaagttgagagatgtgttaaaaaattaggttaaccataaaagggtttttcatatgatgtttaattaaaattggatatataataatagtatagatattaatttctggaataaaaatatgaactaatatgagactgaaaaccttttgaaatattctcaaaatacaaaacactcaacacaagaattgaataggaaattttatggtattttgagtattaatatcaaaagggtgtgactctatggcacatgtacaaatcgtgtattaatgtaatgcttatgattttttaattcactgtcataactatagggctttgaagagttctcatcccaacaaatcttaagtttcttagggaaaatgttgaaggagaaaggaatggaggattgaaggaaaccaaaaggaaattaactagatgagaaaaaaacgaatacgaggatatggaatttcaatccttatcctagttttggaattattattgaaagaaccttaaatttggtattttccttacttacaatattttctttctaatgtctttctcgagggaaacaaacaataacttgatgtctgtgtttgtttaaatttaagattattgagacaaaaatgttctgacatgaatccccttcaatatgcagtagtatgtaacccacatacaaagattctggtcccaactaccaagcatgcctttgctgaaaattgtttcccaagacgggagacatgtgatgccctctcaccctagcatcaatattacagtgtcttcttggccaccaaatgtgattgtaaacatgtaattcatagatcatctaaaaattatgttaagttaggcatttgtgtgattttagataaatgcttacgtgattgatcttaggttgaaaagttgattatgaatctaaaattatttttgaattgaaacaattttaagttgaatttagaattttagtagtaacttgcttttagaatataaaaatttaaatataagtcatttcacttcaattttgtataacgaatttcattcaaaatgatatttgtaaacattggccaaaataatgcatatacataatctttgatattaacactgttacggaggcaagatcttatattctgtaggttgaaatattcaaaccttcatcaagataactgtcaaagatatgagatgtggtcattatcttcccgtaaccgatatctccgcatatcaaggagaacggttttatgctcaaccgcatgacctgagatcatgggtctcaactgctttgccaaagtccaggtataaataatcctctagcaatggtgaacggtacacacacactctgaactctctcttttcccttcacacctgcacacacagcacccccccccccattgtgccgtgttactccgtgtgatcttcttcctcaagttgcttcatctgcataagcctcttgagagagagagagttgatcctacataaaaacatccaacgccattgttggacatttctgttctctccgagcagaacagtggcgccgtctgtggggaacgataaatttcgagtcccaccatctcttaatggctaaaagaaatcagaataccagacgtgaagacccacccaggaatccgattccggaggaggtggtagcagaagatgcgttgtcccacacatcatcatcccgtgcggaacctgcaacgcaagtgccggccaacacaccaccggccgagcaagaaaactctcaacgtttcatccagagcgctctccaatccctgttggctcgaatggagaatctggagaagcgttacgaactacaatgccaggaagacatccaacagctgatcgctcagttggaggatcgtgacgacagaagacgtgaggcagagcgtcggcaaaataccgacgataggcgtgaagaagttcgtacagaagccgaccatgcaacagcaagaaggtcgggaccatcgatgtcgacccgagcagcaagaaccgatcaaccagagcttgttgaccattccgaacagggaaaaacacctcgtccacagcacgaggttcaccattcatccacggccatttcatacaccgcgagggagagactgacgggagaagtcgcccgccatcccggacaaggcaatggcatatataggaggaagtatagccggggccaccaaaataacagcccgttcgttgaccacatagtgaacgccccgtttctggaagacttcgatgggtctttcctgaataagtataatgggagtcaagatccacaagtacatatcgacgaatttgatatgcagatgtgcgtgcggggaatcgatgaaccggttatatctcggatttttgcgacgaccttaaccggagccgcccagacttggttccactcgttaccgccaaggaccattcgaaatttcgaagatttcggccagaagttcttgctcaattttgcaacaagcaagaagcagccgaaatctgagttcgctctgggaaagatacgtcaacagaacggggagacgttgcaaagctatttggatcgatttagagaagccgcattacaagtccacgggctggaagagaatgtccatgtctaccttttgtcggccgggctcaatggatcctcccgacttgccaagtcaatatacaaagacccggttaagtccctcaacgagttcggcatccgatccaaaaaatatctggaattggagcagatggagattgccaattcggccccgaaagataataaaaaaccgacgtcgccgagaaaccgacgaccagaaaatttccaagtcggacaaagtagccgacatccagctattctcccggcaggccgacctccgcgaggatttctcgacaaccgtcctaggtcagggaaatatgaatcaaagtttgaaagatacactccattgagcgctagccggggacaaatttggaaggaggtggccttcacggagatgagaaaagtgacccgacctcctccagtggtacggaaagaagggatggattatacccgatattgtgattttcacaatgggccgggacatacgaccgaccagtgctgggaactccgagacgctatagagaggttcgtgcgtgaaggtaagctgcgccaatacgtaattcgaacccaggggcaccaagccaagaggaaagcccaacaggagaataaaccacgggatgacaagaagagtaagaaggatgacgagttcccagaacccgagttcgaatgcaatgtcatcgcaggaggattaggaggaagcgatacgtccaatcaacggaagaaatacctcaaggaggttatgtcggtaagagaccgacccaagttcaaagaagccggcggcggaaatagtcaaaatgacacacccccgttgatttatttctccgacgaagatctgaagggagtggtgcccggacatgaggatggccttgtcataacaggaactgtcgccaattttcgagttaaacgtatattcgtcgacaacggcagctcggccgacatcatgaattggagcgctttcaaaaagttgaacttgaaggaggaagacctgaggccatgtcaaactatgctatatggtttcaacggtgaaggtaccggcttaaagggggtgattgacctccagttaacacttgggacgaaggagggcttcaagtcagaaaaggtgacgttcaccgtcggagaattcccgtcaccatataacattatcttggggcgaccgacacttcataagtgggacatcctgatgtccacaaagcatcagaaaatgaagatgatagggcacctcggcaaagtcatcacgatttgcggagaccagagagaatcccggcagtgttactataacacgattagggaaacagagggcggcccgtcatcaccacctcgaattcgacaagaagagcaaagaggacccaggatcgagaagcaaccatctcggaaaccaattaatttagtggagctcgacatgcgagacgtggaggaatggagacccgagccggcggacgagcttgaaaacgtccagatcggcgtctccctgggacaagtcaccaaagtaggtaagcagggcgattcagaaaacaaaaatagactcatccaatgcctgaagaagaatcgagatgttttcgcgtggaaggcgtccgagataccggggatcaagcctaccttttgctgccacaagctagcaatgtatcccggttctaagcctgtagaatagaagaataggaagctcggcccagaaagacgacaggcctcaaccaagcatattgaggaattactggaggctgggttcatcagagaaatccaatatacaacttggctttccaacgtcgtaatggtgaagaagcccaacgggaagtggcgagtctgcgttgactacaccgacttgaataaagtctgtcccaaagattcataccccatgccgagtatcgaccagcttgtagataactcggcaggcttccggttgctatcgttcatggacgcttattcggggtataaccagatacccatgtaccccgatgacagggagaaaacggcattccgaggtattaatgctaactattgctatgaagtcatgccttttggtttgaaaaatgcaggggcgacttaccagagaatgatgaacaaagtcttctcggatcaaatcgggcgtaacatcgaagtatacatcgatgatatgatcacaaaaacgccggcgaccggggaccacatccaagacctggaagagacattccagaagctacggcagcataatatacggctaaacccgttgaaatgcgcatttggagtaaaagccgggaagttcttaggttttatgctgacccataggggaatcgaagcaaacccggataagtgcaaggctgtcctggacatgcaattttcgaccagcaagaaagaagtccaacaattgacaggaaggatggcagccctgacccgattcctaccacgatccgcagagaaggctcttccattcttcaagctcttaaagaaggaagccaagatcggatggaattcaacgtgtgaagaggcatttcaacagataaagacatgcttggcctcacccccccgtgttatcaaaaccagaacctggggaaacactcatcttgtatctctcggtcggtgaagaagccattagtgccgccttggttagggaggtggataaagcccaacacccagtatattttgtaagccgggctctcaagaattcggagctgaggtaccaaaaacttgaaaaggtagcttttgccttgctcaccacagcaaagagacttcgcccatattttcagggccataccgtcatcgtccgaaccaatcaacccatccgacaagtgttgcacaagccggatttagctgggcggatgatgaactgggccatccagttgtccgaattcgacatccagtatgaagcccgccatgccattaagtcgcaagccttggccgacttcattatagaactgactccaacgtcggccactcagcagaaggataaggtttggaaggtgtacgtcgacggctcgtctaatgcaaagggaagtggagctggggtcatagtggaaaatcctgaaggagtatccctggagcaatccctccaactcaacttttcgacgtccaacaaccaagcagaatacgaagctctcatcgcggggttaaaacaagtgaaggagcaaggcgcgacgagggttaacctcttcaccgactctcagcttgtttccgcacaaatagaaggcagatatcagactaaaggccccttgttggccaaatatcttgcaaaggtgaaagaaatcatggcagagttcgacgaagtgatagtcgcccacatcccgagagaagaaaacgctcgagccgacatactgtcaaaattggctagtacgaaaggggcagggaaccataggtcggtcatccagcaagagctcgcccaaccgacgtgcgtcatgatcatactcattgccgacgactggagacgacccatcgtcaactatctagagcaaggagtcaccccagacgaggagctagaagcaaagaaactaatccgagaagcggccatgtacgtaatcctcaacggggaactataccgacgaggtctacatagcccgttattgctatgtttggacttaaaccaggccgaatatgttctctcagaagtacacaaagggatcaacgggcaacatatgggggctagggctttggcactgaaagttctccgagcaagctatttctggccgacgatgaaagccgacgcggttgaacatgtcaaaaaatgtgatacctgccaaagacacgccaaaatagtgtggatccccccttccaagctcagtctgatcactgcaccgtggccattctacaaatggggcatggacttgttggggccatttaaagctacagagggtcaaatgcgatggctaatagtagccgttgactatttcaccaaatggattgaagccgagccgttgtcctctatcacctcagctcgcgttcaaaaattcttggaacggaccataatagcaaggttcggaatcccggcggaaatcgtcaccgataatgggacgcagtttaccgacaaaacattccaagcaatgatgaccggccttcatattaagcatcatttcgcctccgtagaacatccccagtccaacggccaagcagaagcggccaacaaagtcatcctcgaagggctaaagaaaagaatgcatgaagccggcccgaactgggtcgagcaactttattatgtgctttgggcttacagaacgacggcccaaacagccactggtgagaccccgttcagaatgacttatggttgtgaagccatgatccccgtagagatcggccagtcatcatggagaaggcagcacacagcacaagaggaagacaacaatgccgccttaactgccgaactggatttaatagaagaagtccgcaccgccgcccaccgttgggatcttcatcaaaaaagcaagctggcccaaaggtttaataggaaagtgaagccgaggtcctttgaaaaggacgacctcgtgttacgccgagcagatatcggaaacaaaaatgcctgagatgggaagctagcggcaaattgggaaggaccgtaccgagttgtccaaaatctcggacagggagcctacctattagagacattgaacggcaagcaagtacaacggacgtggaacgcggacaaattgaagaaatattacagctgacaatgtgcagccgaggtccatgtgttttcctttagttggcttctagtcggccatagggatcatgggactccaccatgtgtctccctttagccggcttttggtccgtcatcggaatcatggacaccatgtgtttcccttcagttggccttagggcccgtcattgggatcatgggattagtgattttcattagatttgcgaaccgggaacctacacccgcgcaattctattttgaggtcacgataattctcattagattgttaaccgggaaccaacacccgtgcaattctattttgaggtcaaaaactatgtaatttggcatgtttttcgtcaattgattatgtgaaccgggaacatacacccgcgcaaatctgtaattgatactatgaattaataaaatccttaatgcaaggaatatcttcgtgcacgaattatgaacgcttagtcgttgttttatattaactcggtcctgatcaggccggcgtaattattcaatctcgggtgaatcatcagagtttctgaaagaattacatctacagattaatatttacgaatatattaacagttgctaagattgggaactagacccacacattctatttaataccgactaagcgattcgggttaaatatttggctatacaagccgacgaaaaaccgaccgacgagtcaaaaatacttggccgttggaaccaatacacaaagaaagcgaagtataaaccggtggatatcattacgaaatgcaaagaaattgttttgaaagcatataacaaaacagcaaaagtacaaagatataaccggcattccggcccttcaattcccaccctcggccggaccctcggtcccttcaggcgtatctgcaccctcctcctcttcctcgctatcagaagcggcgatcaattgaccgttcccgacatatgatttaaagtgcatacccgaggtattcaactcgatgccagggttcaaaaggcgaatctgatccaaagcattattaaaagaagcttcggtagacttcgacaatggagccctaacaaacgagagttcgccgagcagctcggtccgctccctggtcctcttgtcgttaagggcaagcagctgatcgcaatgatcacgagcatcccgagctcgtccccgacttaccacgagatcctgttccagcttcgtaatggtagagcgtgcggattccagctctaaccgagaggtctcatggtgggcccgggactcctcaagctcggaggtcagtttgaccaccgcttcttgtgccgccttgacatccgtacgagatgtttccacctctttaagagcaagatccaactcctgctgaagtcgctgaatctcggccttggaggcttcaaactcggtagacatcttgcaggcctttctctttagcgaggccaaacttctgagcaaggtggcggtcttcaaacaagacaactccatagagcccacttcctccaactcaggagccgagaaaggaaccaggtcggaatatttcttgggcgcccgaaccacttccaaaagatccacagtaaccccatgagtccaaagagacctgggggacaactgttgaggattctcggcatgctcgggttcaggagaagggacagcgtccgtcagaacaggagcatccgaggtagtattgtccgacggcccgtccaatatgacaacggagtcctcggccaccggagaggaacggaggggagtcgctgcggccccaacagcaacctcggcagaaatagggccggcttcagaaccaccagcagtggctttactccccccccctcggccacctttcgcttcttccacgatttcagggcctcaaggtgagcgggccggggagcacggctgagattcgtctcaacagctgcacaaacatcaaaatatcaggcaccaagaaaaagaaaaaaataaaccaaacgttcagatttttctttggaaggaaataaagactgaccacaccgaacataataagatataggggccaaggatcccgactctttgtatgaaattattcgggcggcagaagtggcatcagaatccgacaattgagcttcgtcggttcggtaggaagcggaaggaaggtcatggtgggcagaagaccaatacaaagggaacctccaagattccgaggaagacccaggggggaaagcaaaaaaaggttgttggccgggctcagctacaactttaaaaaacttgtccttaaaccccttgaaggactcagcatacagggtaaaaagccgacggtcaaaatgacgatcgacacgacctcgaaacgaagtccatccctttcggtcggcaggttctttgcccgaccgactagtttgaaccatgaagaaataaaagaataaagaacatgtgcaaggaagttctagtttttggcaaagaatctcgaaggcttgcataaaagcccagccgttcggatgaatttgagaaggggcgacttgcaggtgatgtaacacttgcatttggaagtcggttaagggaaaacaaactcccaaccgagtaacgacatctttataaaataaaaagaagtcggggtcagtcccctctcgggaagaacaaattggttcacccgggaggggaaggcagacataaaaacctccttgagccccgaggggaatcatagcaaggtcctcggaatccatggtcgaggtgtgttgtaacacctcgtgggttacccaggggaacctacctgttaaagcaggaggaggaggtcgagattgagacccggtcgcggattcccgaacggttctggcccgagatgagtccatatttacctacgataataaaaaagagaatcgttagtaaaggtacctggaagaaccgtctcaggacgggaagaaagagaagtcggagctagacgggcagactcttcaacaacacttggcctatcaacaaaggtcggcatcccagtactatcacttggtcgggctgaaggaatgttgggttctgtgggaacaggcttacgaacccagacggggttgtgacgacatcgatctaatactctctcggcctgcctatcatggtctatactggctagatatataaattcctctatgcaacgtggacagtgttcatatcgaatcactgaatccggttcgggtatcgggtaggcttcggattcatcccgagcagcagtatcgggaagaggggaaaccctaggggacgccctagattgcagagcaagaagtgctggcctttgtcgggatgatgatcctaaactagaaggtcctaaactagaaggtcctaacctagaaggccctaatctggaagggttggggggtcttgaaagggaagctttggaacttccgggggcagaaggagccctaagcatggattttttcttttcctcttcagaaaggggcaatccaaaaagccaaaaagcagtacgaggagaaaccgttttacggatttcctcttcttgttcaggggtatacttcatgcttaaggctaaggaagggagaaaagaaggtgaaagacagagcaaaacaaccaagaaaatgcaaagactgagcaaagaaatatcaatgacgaagtacgaaacagtaaaatggcagattaaagagacgcgcggaatacctggagaggaggaaggaagaaaggttgatggtcagaaacgagcaactcagagaagcaatgaggaagacaatagcaatggagactaaagctaggaagaagaaacgaagcagaaaaagcgcagtaaggagagaatgcagaagtgtagaaggcagcgataaatgagaattaaaagtcaggttaatagaatgaaaacggaaaaggcgcattaaatgagaaagtaaccgccagaattcgaaattataaataataactgttgggtgtaggggcaaggctgtcttttagcaccagaagttatgattgaatgtgcagagaaaaaatagattgacaagacacgtggcgataggggaataaaagacgttccattcccctacgccctagtagcacagactgcgttgaaaaggcgacgtatagctcggcgataatactgaagtgactaatgaattgacagatgatatcccgacaaggggcaaagtcagtacgcaacaatactgatcatggtcatatcggcccggccttgataatgtcggctcgggcaatgggtacctcggataatgtcaaagttaagtcaggttggatagtgatcacctcggaacggtctcaatcgctttaactcagatgaagataacctcggctcggatatcaatttcctcggttcttcgacatccttttgagcaaatcatatcggtttgagcgcaaatcatttctgccaagattactcataggaggcatgataggcattcctattatgcatcccggtcatccagaatgctaaatgaccgggctgaggggcatctgttacggaggcaagatcttatattctgttggttgaaatattcaaaccttcatcaagataactgtcaaagatatgagatgtggtcattatcttcccgtaaccgatatctccgcatatcaaggagaacggttttatgctcaaccgcatgaactgagatcatgggtctcaactgctttgccaaagtccaggtataaataatcctctagcaatggtgaacggtacacacacactctgaactctctcttttcccttcacacctgcacacacagcaccccccccattgtgccgtgttactccgtgtgatcttcttcctcaagttgcttcatctgcataagcctcttgagagagagagagttgatcctacataaaaacattcaacgccattgttggacatttctgttctctccgagcagaacaaacactatatttcatttcagcttatgttgcgagttaatgatcacccatgatcgacaattagcattttaagccatgcatcatgtttggaagaattcaaggaaaaaacgtgcaagctataaatgagagcttccatctggatattaaaaaataaaaaaaataaaaacatgttgatgatgcaaaataccaaatacacacatttagacttgtcagagcaattaaaaaaaaaaactgaaagttcaaaacagttttccgcagcgggattcgatcccggtaattcaactctaaaaactagaattatctgtgtgctactgcagaagttgtaacatttattgcaaagtacattataaatagtcattttaaacagttgataatatagcaaattaaataagcattccatttcgtcccaaaagaattacttaatctaatttggcctttgaataaaaagttactaaatattctttcaatacaacaaatacgagataatagttttatttttctttttagtatgaaattaatccttaaaatagtgaagaatatatcaattctataataaaatcatgacacaaattgatcctataaaatattaactcgaataaaaaaaaaaactaaagtgtatatcacctttatggtccgcgccttttctgttttcttctattcttctgtatatatatataggccatgtttatttttcttttaagaaaaataattattttttaaagctctttaaaaaataaatttttcggtaacttcaagctaggtaagttaaattttacaagagcaccagaaacatttaccccagtttaatttgtgggcatgctggtcaagaaattttgtctttcataggtgttggtctttttggaataccaatttactttgtgtcattgtgtgatcatgtgcttgctagctcgtggcaacactcataggaggattcatcctcctacgtatcatgcgaaatcctctaataataacaaaaatggcaatggcatgttaaacaccccaaatgccatcatggacttgtgcttacaaagttttctatatttaccatgcatgttacacagattatctgtataacactcccaaaacttaattatggcattatcaaagacaaagctaattcatcatgatgagggacacccaccactctcaaagttgaacttaagaaagggagctaaaatgatcatcttctggtcgtgttaagtaagccttgacttcttttttctcattaaaaggaaaaaaatcatacaaatttgttgagtacattagactatcattaaggcaaggaaataaattggtgcacaagcaaaatcaaataattataagacctcttttttactttgcttttggttcccttttttaccggtcaaagtctcgtggctccgctctaccataattgggatctcaaatgcttctacttagaataagtgacatggtttcataattggtcatggctcctagaatgaatttatctctagctaactagcttcaggtaaatttcttaaatagttagggatgcatggggccttaacttattgttgctataatattattgttggttccatacgacaatagcagtgattgaatagtaattctactcatatgagtgtgtagctgtacccaagctagttcaacttccatacttttcactttcgaatgcacatagatatgattcacttccgtttgggttgatcacactttgactatcttgtagtttttaactcaaacagtgtctacgtctcaaaatatattgaaatctttttaaggtaagctatgtaatgcttaatcattgaatcttgaattctttatttaaaaccaaaatactgagaatgttacaattataattagttaccatgctaatatcactttcacctttgataatcccctctaataacttatcaactatttcaaacaatatttattttcatccgttacttttaacaggcttaagaaaatacggtagcttataaattattagcttataacaaaataagctactttaaccataaattctattatggtgattaattacttcagggttttcatcgggttatttcaagatctcaccctaaagagtcaaagactcaaataaagtgattagaaaactacataaattctagtgaatcataacttaaagtatgtttgtgtctatttcttggaatgtgaagtaggagcaggaaaggaatgacctgtctccagcttgttcatcgattcccattttccgatagtgattacagaaattcatgtttagatcctagtgaaatactaaaaaccatgctatcacattcaactaaaataaaacaaaaaggcaaaagcttgtaatctacaaagtagattttccaatatattttgtcaagtttttattgtcataaagccaaggggccatccaccatgggagtaaaacaaattaaaaaaatgttcacaaccaaaagccaagaactttaatttccccttttctaaagcgagtaaaaacaacatcattctttgtaagaaaaagattcatgtgctcgttattaacatttacatggcttatttgtcaaaccccccaccagtttgaccaaattattatttttccactgttctcaggctgaaaaaaataaaaataaaaaaggcttgaatcccgacagattgttttgtaaatgtacacagagatcttatgacctatgaatcatacaatatgctagaataagactaaatagcaagatcaaacaattgtgaaattgcaagattcaaaattaacgttagtatttctagatttcttccgtgcaaaagaattactctttcaaaacctaaaatctagtgtagcatttgatcatccttcaaatatgctcaactagtacacaacctttttgtaaatttgttgtttgcagtcgcatatgaaccctagctaattgattttggtttaatggttaaaacctaaaatctagtgtagcatttgtaaacttttggttgaaaatttactctttcaaaacctaaaatctagtgtagcatttgtaaacttttggttgaaaatttactcttgatagattactgaaagtatatggagctaaggcacacggagacacaattaattaaaattaaagcaagttgagaatacaaaagtcaatgatgtcgagtgccacatatgatcacagtttaacataattagttatatagttcattaatggctctttctacatattttcaagttttaatggatatttttaggttaaactgtactttagcctgcctaatatacatcgtcaaaattcaaattaggtctcctttttttttcaaatttaatcttctactattttaattatataattttagtttgtgttaacttaacatttgatgtgtaataaaactattgacatgatgttttattgtattatatatgatgtgaacacattcatgttgatgtgatattctattgtatttttatgttaatatttatttacctcaagttaaaatatatgaatcaaaagtatatgattataataatggaataatcaaattgatgaagaaaatagacgtgtgaaattggaattttgatagtggaaaaacttaaaagtgtaattaagtctattttttataatacaagttatatgataatgttctgaagtttaacaaaattttattcaatttcttctttaataacctatatttgagtttgtggataattgtgttaaggaagttaaaagaacaacaatttacggataggatttattatattttttgaactataaaaattgaaattattataaaaaatttataataacttatacattccatttgatcaattttttttagtgatataatttatttgatgaactgacatagacagatacacaattatattgaagttcaagacctctctctctctcatgcagtgatcacacagcaacatcacctaagcaagctccaacagaagcagcaaaggctctctcttctgtctctctctggtccatagttgtttcccaagtagtaattaaaaagggatccaaacacattctgcaccatatttatttgcattaaggcaccaacccctatgcacagtcattgactctactcattttcagagctcacacttcaaggttactcacactatcgaattcaaaataatccaatccgcatacaagtttgccaaaatcacaccctgaccaaaaaggaccaccacatcagaccatcacatcacaccctcctccaaatcaactagtagtacgtatcactttacttcccttcctctaagctttattattttttgtttcaaagtatttttagtgacaccctttttgaatcagatccaaaagaagctactagtttaatctgtttctttctttatgggggtttgagccaattatataagttttccatgcacgatctgtgcctagttgagagcatgaggctgatgagtcaggcttgtttctcaattctactgttgattctgttcttgttcaaaatcccatcatctactgctaatgggtatgcaaaatctcaaagctttagaactgagcctttgtcaaatcttagcccctttaaaggaaaatcacgacagaacaccggtgaaggtggtagtgaagcggttcttggtgatgagaaaaggataatctacactggtcctaatcctttgcataacagataagtggaaatttatagttctgaaggatctttttttgccttgtttatttcaagctctctctgtaatctgtgtatatataattttgtatctttttgagtttttttacttctttacatgttctttctcccatttcttttcttgtgaaagtttgtgacatattttcatggaccagtttcttctggtgtattgtcaataaccgtatgtaagaatgcaagttatgttaccacgaaacatctcaaagaaaataattttggctaacgtgtttccaattccataatgtttttggaataaaatttaacttttatgtatagacagtggaaaggtttttttcatttttgttctgtctaagtaaattagaaataaagtttaattcattgacagtgtagacactttttaattataagtgcatatactatttttttactctttggaacaagggccaaataaagacaggaaatgcaatgatgcatcatggatcatttggctggcattaatggagctgttgtggtgtagtgactgtttaatgtttaacagcttatgttaatctatgcctttttttgtttttatatttccatgcaaggagaataaagtacgcagacaactcctgctatatcttttacacctttgttcatataactatagtttatggttagttaattagtttaaatatattgttaatatgatacgattcttgttcagtccaagtaggtaagaaattttagtcaattttgctttggattttgggtgcacctgaagttcagaatccagagatttattaaaaaaaataaaataaaataaaattgaatatcatgttcatttaaaacagacaaaactcgaacctgaaattcagatgatcagaacttttccggtcgggagttgaacgcggaattcataattgaatttaaccaatgggccactacagacactttcatattttgatgcaaatatttatttatatataagattttttttaaataataaaaataaaatatgataatttaaaaaaaaatattccgcagggggagttaaacccggaattctcaattgaatttaaccaggtgtgctactacagacgctttgatattttaatgcaaacgtttaattatatataagattttgataaaacataataaaaataaaatatgataatttaaaaaatattccacagccgggagttaaaaaaatatgataattttgatcatcaattaaatctaaacaaacgtgtgaaagaaatctaaatcagttggttaagtaaaagtatgagttattgtgtatgatattgtttttgattcttacggatcaaaaccctaatcatccgaagactactatcaaatggactgaaacggtgcaaggcattcttaaaggaaaaattcgatgcatctatggttttgaggatgaagtttaacacagtagtaaagttatgtcttgaagacttgttaatcatgaattcgaattcgaaaatagtctttttacatatgtaaagataaggttgcatataatatctcttttctttatttgcatatagtgcgaaagtctttgaacaataaaatatgtaattttattttattttatcaatgattctagttctggcaacttctactatgcttctccccacctgccacgatattcattttgctgaagccttggcctacaggtgggccattgaattatctgcggatcttatgtttagcaacgttaagtatgagagtaattgcatgcccctagccaacactttctttccctattaatagctattttgatggttttgtgttgggattgtgctattttgcgtagaagcacatccactcattatttatctcttgtaaataggcaggctaatagggttgctgaaactttggctaggctatcctttttgtttaatgagttccattgcattgaggagacccctccccaaattgtggatattgttcttgatcatgtattgactcaaggctttttctgtttcttaatatatacatctgacttaaaaaaaaaaaaaaaaaactttgtgtaatacttcttattttttaatgataattattgaatatattttgtatttttatttaatttatttttttgtatgatgactaataaaatgtgttttatatttgcatcaaaggtatttatttcattttaatagtttttataaaataatagaatttattcattttttttataaaactattccgtagcaagaagttgaacccgaaattcatctttggaatttaactaggtgtgctacttctgatgttatgataatagaatgtagacaaatgtatgtatggaatttgtttttgttttttattgttaatgcagtaggttcagactaagtttataaggttttttcaggagtttataagcttttttaattaatttaaattttttgataagttacttaaaaataatttataaaaaaataagctagtttataagttattaattttttcttctcatttttatacttagtattttgtttaaaatttcattttatctttttatttaatttaaaaattaaaaattaaaaactctcttatctttttttttcactgtcggaaaaaactcgtttattttaatgtcaaattatttattttaatgaattattacattgttttttatttatatttaaaatatttggttactaaatcaaagttgataaaaaaaaattatatgtactccattatatagcaataaaattccaacaaaaagggattaaataatattatgttcttgttatacagataaaaaaaatgtttaagaaaaaatataatttttttaatttttgttttaaaataatattattaataaagtatttaaatgttaaaaaaataattttaaacaatgtaattctaacaaagtttatttaatttaattttaattttccaaaaaatggaaaaaaataattttaccattttttataacacaaaattttaaaaattattttcctactttttaagatgataaattattagaaataaaatttaaatattaaaaagtattaaattatcagttaactttatcaaatatttttaattaaatccactaacttgtaagttttgagttaacttttagctttttaactctagcttatagtttataagctgaaagcttacaagctagttttattaaacattaaaaaaaaaatcataaagttccaactaaagcaaataattttgaatattctactttgcggaaaagaataagttaatagtttttttgaagtttgttgattttcttttccagcgaaaatttgaagccaaccaattttccgaaactagctagacagttttatgtagatttgtcaaaaataataatatatactctaatttattaattaaattaatttaatgatatttagttaaataaattaatttgtatataatcaaacacataagaagaaatagtattataatatttgtatctttcaggagaggaaagagtaatttatttttatttaaaagtagagatttgtgtaaaaaaaatataaatattaacacttgaaatatacaattacaattttaatttaattaaactataacgagctactatttataaggaacttttatatttttaagacttttaatattgtagctccttttaaattttcaaatattaattactcttatgtgctagtgtgatttgggtgacattgtaattcaccacaaggaccttaacctctaattgggccttagggaccccagcctccttagtttctagttcggctcaagatataatcctttcatattttttcatgtctcaaatggtcagatttgccttttttttaataataaaaaaaaagtcaaattttcctttttcaagatttagttcatattaatattttcaatccttacataagaaaaaaaaacattttcaaaatccaaccatcttcatttcaacttcaaacttaaaaatctccgcattgcaaatatctctacaacatttattgaattagagtttgtttacataagtttatctaaaaacacttttagaaaaaaaaaataagaagaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccgatacttaaaaaatacaaatagaccacgtcggttactttccttttaagatttttatgtgggaaccaaaaaaacttacttaattttctctttcctcaaatagtgataaagttgtccattttatctttttacaattttatcccacaataaatatataaatattaatacttaaaaaggaacaaaaatactcttatcatataactgcatagttgtgtgattcaacattatgctaacattttttatatatataaaacgagctaaatgttggcttctaaagacataaatctaattcacctctcaattcgcccaatttgtgttttcatccaatgttgaaaactaaatcagttatctgtcgtgttcatacttcaatttagttgttgtggttctctaatttctttctctaacgatagatgcatatgacttgttgcttgactttttggtctccacaatccactatcataaacattgatagttctctggattttgggtttgctgtgtgcaaactctggcgttttgtgagggtatttgaggtctcaagtaaaagctacacgggattccttaaatattgtacactgtacaatatatatttaaaatttaaaattttatttttaactccaaaagctctattaaaaaaataatctaaaattaagtaattcttcatcttcatcatccatagattaagattagttatttattataattatgaaaaatattatcattgtaatttattgcattgtagacattaatgaatgataactaggttacttattttaatttttattctttatatcaatataagtatattttagaatttgtgggttttacgacgaaccatggtggcatgtctttaattccacttacaatagctaagaaactcaaaaaagttagaaataatgcgagatgtttaaaatattatgagtaatgatattcatacaattatatttataataagttatacaacaacaaccacattagcacaaaaaaaaacaaattttaataaataaaaaaataaattccctatcttatctaacaggttagcaaaaagaaaatcaaatcttaatttaaaaaagaaacaaatccaacaaccaaaaaatatcgaatttgataaattaagaaataaaaacaatctagtggaatctctcatggtaattttcattgaccgcctaatccttcccgcactcttgccccctccttcaatgatttttatctcctcatgcatttgtttaggcatccaccattaaaattcctttcatgttctgcaattcaagtatcgttaccttttcactgagagtgtataattgaaactcacccaaaacacaaaaaacaactaaactacccacaccttaatggtgctagattgagtttttgtcacttccaatcttttatctcatctatgcatagtcccgacatatggagcaattcaattaagatacgaaatttgtttttctttttactaaaatttgaattttttttgctgatgtggtaattgttgtataatttgttgtaaatataatagtatgaatatcattactcaaataatatttatattttttaaagaaagcactaatccaacttaaaaggttttaattatggatgaatgtatgaacaagtctgatccgtttaagattcgtgaaatatgtgttttagatgtgctggataagtttgatttacaaaataaatgatttttttttaagatatgtattctacttgcaaaaatccgtgaataaatggattgatttgcgaatctaaatattaattgaaaaaaatattttttataaaaatatttttagaaagtgaaaaatgtataaaataaaaaaaaatattttatttttaagataaaatctatcatactaaaatatacaaacattttaaacataacaaaataacaataataacctaaattaaagaaatcaaaatcttaacataacaaattaattaatattattttgacgttaaatttagtctagttcatgagttcacaaataaagcccgataacacgtcagactcaaaagttcaataatattatacaaacttaaaaaaatggttatccgcccaatccgtgaacctaagtctatatatgcaccctagttttaactacttaaactctcctctactctacaatttaaattttaagtcacagtattgaaatagtttaactttgttgttggtctattaatatacttctcctttctggtaaataatatagaatttgttgcacgtaaatttacgtcctacaattttatcttacgcctaagagccaaaattgcattatgtatttcttacaaatttgaaataccacgtacgcctaatcaaagtgcctgcgatgacgctggtaacagaatttattgggatataggcctattcaagagtccagactcctaaggagggtcaatgggtaatggcaccattaatatttatttcctcttgtggcctgtggcaatatagatatctactatgtcacgggtaagaggaccttgaccaaatatgcattaaatttgtttaactaaattgattctccatgacttaaagtaaacattatgctacttcttcttacccagtttgtaagaggagaacaaatattattatgttactccgtatgaaattgagtttggatttttttataaagtctcaaatttgagattaaaaataaaaagttaagaaaagtgactcgatgattatataaattaatcatcaataaaattgataaatatttcacccgcatgtaaaaagaaatataaattttatgagatgctgaatgtgatcgtttggtatacgtttcaatgatacctaaaagggagagaatatcacaagataaattatacgcttggtacgtaatgatgcaaaattgttattaagaaatcataagataacaatagggtcacgataaacagcaaaacatagtgaattaagttgcttagaataaacattaacttcctttgacatttatgaaatgcagcattaataaggccaacacagaaagggacagaacaccataaaaaccctcacaaaagctatccattcaattctggtagacctatgaactttgaagattactttgagggatgacaacaaagttgctcaaatatatataatccaaatcccttcattttaggaacaacaatccctacgctacagctgtttcccaagctctctatcattgtcttgtctttttaacaaaaacactacaccttgtgttatgtcattgcattataagtctcttaagtttagttttctgtgtcaaacatggtggatatgatggatatctctttctccaacgaattctgctacatgagtgcatgtagtttcagccaagagatgtgcttctacagtgcaccaactagtcctagcaggctcaaactaagagcaccctttggttctcaaactggccccacaacaccaagagcagcaacacatgaggatgatgcaaactccaatgtggatgagtttgaatttgaaactagtcgcaggttcaatgttagtgtcggtgacttggacaccgagacaaaccaaaaggatgagaacccttttggtgattcattgcagactatggcatttgctgatgagctattctgtgatggtaaagtcttaccactgatgccacctctcaaacttcctccaaggatgcatcagaatggagatggtagcattatgagcactcacagctcaacactgacgtctccaaggtccccaggatcggtgcttaggcttcggttttcgcggcaaagtttgtggaatgatgactttgatcccttcatggtggctttggagaaggtcagagaagaaaagagagggaatccaagtgcaagacatggtctcaggaggactagatcactttctccattcaggagcttcaacaagaagtctgaaaaaaatgtgggaatatcaaagtcaagtcaacttgagtcacattgttgtgacacagctcagctagtatgtgaacttaagaaagagccattaaagcaagtgtcaggaagaataaatgtgctatcagagcccaaagggttgatgtttgcaaaacaggtgagactagtgggagggagcaatgatactacaaccttggagaggacctcagtttccaaagttgctatggaaacaaagaaagatgaggggaaaagaggtggtttttggagaaggaataagaagagagaaaatataaagaagtttctctttgggactagtaacatgtggaaagccaatgctcatcacaagttagaagataaaatggcagcacaggagaaacaacccttggtgaggaaacttgacatgaaatctgtgaaagcaacagaatcaacacaatgggataaagatccaagaacaggtgagttgaccaaaatgagattggtatgtcacaggccattgccaagattttttctctgcttgggttatgaggaagggaaataggtagaatgtagaagttagctgaaatgaatgctttaaattacaattttaaattctattagtgttgctgtgatgttgcctctactttaccattttatactatctagtgggaaccatatgataccaatgctttttagaaattggttatttataccttgtctagaaattttcccacatgaattggcatataaatttccctaacaatcttcattccctttatagtcctttttttcttcttgcacataacgattgttgaatagacattcatttttctgggaaaataaaacactgaatggtagattaggtgaatcagcatgagcgctgcattctgaggaggctacagacctcaatcataaattattgccaaaagaaaaatcagttagcgcatagagagagcattttttagtcatattgctgatgatccgtttgcatataaacaatgcctgaaatacttcttacatcacttggtacgaaagttgtattgctgtgtgatttcaacgcttaataatctgagaaaatcagagattttaatcattctatatattgtggaatgaatgttctacgccatcagtgcataaatgagcaatttacattgattgaaattacaggctaaacttaaccatgaaaaaatgtgataataaaaaaggggaacgtaaataggtagcctcaaacgctcatttggtttgaatgatgagaatcctatacccctttgtctctaatgcagaagaacctgcctctgctaatgcttaataagaatactagtcttgatataatgctaagtagaaaattaaatctgattagtccaagacttcagaaggccaaatgcttttccaaatggaaatctcagtctcactcttaatctttctgattcctccataaaaaccatctgcttcatttccttcctctctatgatcttttctacttatagttgtcttactccaacgcgagtcaggagtgtactgattgaactctagcaccactgtgtctgcaaccaacaaacacataatgcagtgtcaaataaaccatgtttgaatcctaagaaaggaaatagaaatatacaaaagcctaatgccaagactagaaaaattgacatgttcagttttccatttggcagaatttataactattcaatattcgtggcaaaaagcttttgatggtatgactgcatggtccacaactccatagaaaaaatagacaggtaacatgtgtaaaaactgtcttcatgctgacacaaagtgatgaaaaaaatatgacaatagagttttgcacaaaaaaattccttttagaaagataacagccaaaagcaatgtgtaataatggccaggaagatactgaggcacaaattagtaatttgcattattattattctgttgctattgttatctatggttaaggaaatgttaaatgaaacatcagaccggatagctaagcagagattgtggattattctggtcataactactaatatcagaaaaaggaagtaaacttttaaggcttatagtgactgtggtatccccatattacataacaaaaagaaaacagaacataaaagagaaattgatgtttttctttccattttaacgtagttggccataaatgtatccactgagacacaaaatatcactgtgttggtggaatcatgacatgcggaccatgatatgtctaggggaccaatcatatatcatagctggtggtccaagttttgatatattatcaggaaaggaacctagcccaaattgtggtctggtctgccataaactttacatttatgtaacttttttcaccattaaacctccacaatgaaaaacataataatggtaaataacaaaactttaaaatatttaatccgttaaacagtatttcaaccttcactccaatcctgtgtcttcaaaattctggagcattttcttttatctctctccatttttgcatatttataaactattcagttgaatctaagaaaacataattcatccgaatcctccaatcattcgttcaatcatccctaaatcacatcctccttgcatctgtccactaagcaattttactcagaacataattcaacttgaagggaggaacaaaaatcattgattaaatgaatgataaaacataaaaggcaaaatctacagccaagaaaatataatgaatgataaaacacattcatttaaatggaaaatgcattaactcaccactactatgacaacggcagtaattttcattcccatcgcataactccaagtggcctacaacaccataccaccaacctgccataaaggtgcatttcatcaatctactatcacaaaaagggtagatggatgtaaaggaaaatgcacaattaagattggagaagtaattatttttatcagactcaagattggattccactttcctctttttgtttactccccacagtttgtattcatcctagtttttcttttaatgtccatagccactctttttttatgcttgtttaaatagctctttaacgatattctaaagaccataaaaaactgtaaaagtagaagaatatgttgagtaaaggaacaaaccataaggaaattctttgtttcttctccactgaatctctacatgatcacccggatgcaaatcatatagacaatcagagatatgaagatcatgtggaggagtatcaacaggtggttctcttagcctttcccatggaatgccatgctctactgcaactgcccttcttccatgtggtggatacctgtaataaacaattgatcaataataaggccactagatctatcctctttttcttccttatggaaactcttaaaatatattctctgtctgaattatttataataaaaaaatgatgataacactagctttgtaatcaattccttttgccatttctatttttcttttgaatcttcattactgctctagtcacgttttatttcttatggttaacaattatttaaaatgaaaaataaataaaaaatagtatgattaaaagcatagcatacaatcaagaaagtattgtgtatggtttaccatcaaagttaaaaaaaaaaaaaattgttgcaattgttgttataagaatattcataaaaaaattaatttacctctgcgaattaaattttaacttttaaacaaataacatgaaatatatattctaattctggtgtgtgtatatgtatatacagaacatgtgtatggatgacagaactataatataatgaaaatgggttgagttaatttttaatatttcttctttcaatgactgatgggaacatacatataatcaccaagaatcatgtccaattaaattacctggcctggaaggtgtcagtgtgaggatcatagctaagttcagcatcatagcatgataatataaatccaacatggccattctgcagtgaaaaatgtaacttgtgagaaaacacaacaatcttctattctagttaccataaaaaactaatttgttttactattgaaggtatcatgatagaatataagttttcaatagcaaaaaccacaaagggattcataatcattgatacctcacggttatagacctgagcaggaaacctgaaattgccagtctccagagcaagataccaagtcatgagtgaatcaggaggcaaataactttgctgcttgatgctattatttgcatctaccttggttctcatccatgtaaaaggccaactaagggacacaagtctcaacaagctcctttgctttccatgtctaagagttccaacattccctttggaagcaacatgccatttccactccctataagcagcttgaccaataactctaccccatttctgtttcatgtgcctctcccaaaggtgatcactcacacagctctctcttagggagcggcaaaccccggccatttgacaaagtgaagttgtagggagcttttcaagaatgcattctaacaccagctctggcaagtccaacactgacatatcttgggagtcctcaatattctccacctttgaagacttcttcattagagacattcttgtgggaatttgacaaagaaaaccaagccaaaggtggttcctaaacaacttagagatggacttcacagacaagtctttgtaaaacaaaggggagatcaacctcacttcacttgcccatgatgggagtggtttgagagataggagaggctttaaaaccagaaagaaggagatgcaagtgattaagtagagtagcattagcacttaggaagtaggatatattccacaggtcaagtttggcatatgtgataatagaaccttaaagccaattgtgcaacaccaatggctaacaaggggaaaagcaaaaccaaaatactttgacacaaattaatggcacaccctcccttccttgttggaaagaaacacaggaagcaaattggaaccttcaaaacaaaacaccttttaaagatgggttttttattggttcggtgaaagcccaccaaaacccaatggtaggcctcctaggccaaagttagatcagaataaattaggtatagaaccaatcgaatgaaccatgtaatgctaactctatctcctattggtttccaataaagaggagagaacaacacaaccgtgtagtcaatctaaacagctgtcattcaatgaagaatgaagaatctgtatacaatggtccttataaggaggggaatatcaacacagcaagaaatggaggtggggcaaccaagatctgataacaggttttataacaccgagaaatggaaaaaaagatggaagatgagtctatataataagaaccaaatatatgttcagaatctcaaaatcttattggtaagtggataaatcttctgggaatatatatatatatatatatatatatatatatatatatatataattggtgtgtagctagaataaaatagatctagctagttggaacttaagcagcaagaggcccacacaagaccctcaagatccacaaaaacaatggaaccaaggcaaaggtcaatctttggggtggtgcagaatagatagatagagaagaggattaaacagagattctgatgaagaagataatgaatgtgaagggtaggtgggacctcccctcactccaacaaattcttcaccacacctcaattattatcctctcctctgaaaatgcaatcacagaattctctctcttttttttttcttccttcttcctgttgttgttcttgttctgtgtgtggggcaatatagagaaaaattgatggacaatgaaaggaaagggcagagttatttatgaaaaatgaatgggaggctgaggttacgtaagatttttgtggatgtcaaacacatttcagactcttaacatatatccatgtcatcaccaatggctattgctctatcatgcaatcattcaaggattctcataagaaaattatatagataaataactttttttttttaccctaatattttgttgttacatattatttattgattttgttaataattaatttttatcaaaaactcttactgattatttttaataaaattcattttgttcaatcatattttttgcgtctaagtgagaagagaatcaaatctaatattaaacggatgaactacttaattgatatataaataaataaatagcaatgaattttaaaacttattttaaattattattatttttatctccagaaaatcttgtacgctttgtttttgttgtatcaagttctagttggagggaaatatgtctgactagaaaaggcaactacatcggataacgtatataggacaagattcgctaattttaatgttggaggttcgaggtaaggggatttggatccgctgcacctgcgtccactttaacaaacatgttatcgctgacaagtcacaacaagatttcaacattttaaacaattattatcccctctattccttttattttcaataattaaatatctgtcatgaatattaataagtataatcaattatattttattgaaatatttttctctatgataattttatctttcttgcatgtttaatataagaagtgatcaacttatttcaataataattcttttagaattatattttattttatcatttatttttttagattctataggataacattaatgatttattataattattaaatttaaaaaaatgatgagagtaaaaaataattttaaaagaattactttgtaagttaatccctcctgtttaatatataatatgaaaaaaattaagagtagactaagtttaatcaagttgtcaattcgttgacttttaaaaataaaaaagtcagcgattgggttcctgttaggccttaatttgactgaaggaagcatctagaaatagatttacacgtatagcaggaatgttagtatttttatgatgagttataatgcactatgcatgtgtatcattctaaaattatatgtttttagaatataaataaattaaatgttggtcatgatatcaaatttacttcgtcaatgcaagactcgatatcaaagtgataacaagagtttgaccagcatcttgatttttttttaaaaaagttacaaaggtagttttacttttcattacttttttttttcttactagaattaaaattgttcgatggtacgaaactttttgatccattctttttttcgctctttaatttataatgaataaatagaaattagcaagttaaaagtttaatttgaaaaatcgagacattgaatacgaactaaaggattcattcatttatttttcatgtactcatgatgtgacatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattatataaacagaatcgaatttatcggtatttatttaaagcttataatgtacttttttggtcttattataattattatataagaaaaaaaaaagtatttatctcaaaataattatcattttagtttttaaacataatattaattattttttccacttatattcttttatgatattaaaatgatatgggttataaaacaaaaaaaataataacaaggttaattttataaaaaaaagaaatttatctatttattaatttttttatctatgtaaaataacttaaaataacaattataatgaaatggaagaagtaaaaataagtaaatttgtctgcaaataatttaattacgagacatccacagtagctcgcgagaattcgtgaataaatctttcctcatcattaaaaacctagtgagctattcctcatcttgagacacaacgcaatataaccattcctgttaagcaaagttcctatgtagttttgggcttaacaaatctaaagagaagggaagagagagtagaggaagccaacaccatcccatcctaagactagtatcaggcatcaaggggttatctactcctaccttattatcattaatatggtatattagatggagtcacatgcaaaacaaatttgaaaataatgcataaatgagcatctagacaataattactgtaatgcaaaatatattccaccgtagagattttagttttttacttttgaggccttaagtattaatccatatcaaaataaatataaagcagagtaaaatcaagaaagaaaaatacaaaactaagagatgataaagaaatttagaaaaagcacttgaaagtaggcaatgtaaattcatgaattgaaggcaatacctattgcaaagaagagtgatgacagtttttatgaccccatcaagcctcaattttttcttcttcctggtcacatctgtagatatctgaacaggagtgccatttggaccccatttttaattctgcacattgctcgacatttaatattttagcagtgaaaacatcactgtaggtggaagcaatcttaactgcctcttctgccaacacccctgaggtaaacaaatcatcaagcacagatcaattttagagaagcaaaattccctcacagatatgaaactggccaactgcacgccgagaaactacagaactaggaacaataatcatatatcttatacattcaaagtgttatataaagagaactgaatatgattttttcataaaaaatagtttgatttgataaaatatttgtttactttgtaattataataatattacctttttatttttaaaaaatgtacagaaaaattagaagaaaaaataaagtactactttgtaattataaatataaaaaaatgagaatgagaataagaaacattttggtaccaaatttcaccttttgttgtaattataataatatgccgtgtgttctcttggtttctcactgtcgcccaaaacacgtcaatgtcacgtgaattaattatactttagtggattactaataaagtaagttattattatattattgtttattttattttattacattcaaaagtcaaaatgcagcattccgtccataggttagcttcctttcacatatgtgggttggttcatccactccagaactgatcatgatggacagaataataatcttaaaaataatataaaataactatgatttactctcatgttctaatgccaagagctgaagttaaaaagataaaaattagttacattcttctatggaataaatttttcaacaacaaaatcacatcaaatcctagagaaattaataaatagcatatgaataaatttctggtaacaaaggtagatgaagttgtgcagagaattcgaaactatttttttccaacctccactaacactaacataactaaaaggtactaagtgggaaaaaaaaaaggtaatcacagttgaatcaacagtgatataaaatttgaaagacattgaataagtatattaaataaatcacaaaataaacaaagtgctaggaggaaacatattgaaacaccaagagtttctccacacctgatcttgagcaaatcacaaaataataataagatataaacttatttagagatatgtgtgaagttatcgtaaggatacccatatggaagatattaaaaattatattaaaatatatcaatctcttagataacttttttctaaagagaattccttacacaaataagctccaataaattaattttctacatctacctttctcttatctctaactagcatgataataaaatagggatactcagaaagcagaacagggttttcagaggcaaaaaaaattctcaagtttgttcatatggcattaatacaattcatattcatatcatgagtacacagaatttatgtttttaacaacatagtcatgtaaataattatcacccataaagagatgaaattacccatggaatctgcaagtgttctaagtcactcattcgctattctatcaaggaaaatctaccagacaactcaaattagtacaaaggatgtctgcaaagaaatctaaatttgtacagaggcaaaactaaacaaatatcagaaatcattggtccttagagaactttgactagcatgctagctagttggtacatcaaattatccttgtattcacaagaaagaataaggatgaagaaagaaggagttgcatgactctcattcctctaatcttcaaacatgttcacatatgatcagtatggtttataattcatcagtaataagataaacacattttgccacaaagtcacattattcatcaattgaagcaggtgaaagccagagataaaagtctgagacacccgaagaaagctccacataaactaagaccaaaaataaacaaatgcgtaaaacttacatagctaattgtatcatggcctagtaagtaatttgctatggcttttgcaaagatgcttcattcatcttgaaattaaaatacattaacactctctctccctcttgagaaaataaaaacagagacgcagtagttattaacaatcaaatcgatgtctgggacatcaattacaacaatgcagagaaagagattctacgaacacatttgtcaacacaatctgtcaaataaaaaacaatgcatggcaccaattaaggtcaaaatttaactgacattaacaaatcaaaaacactaacaagaaaaaaagaaaatcttacgcagtaatttcttggcgtcctccttgagttccggtgctaacaaagaacccagctggttttcctgcaggcttctgctccttccacaagtgccccgtggagtcaaagaaagccttcatttgcgccgccatcgacccgtacctctgggaaacccaaacaacaccccatcggcggtcgtcaactccgccgccgtaacctctggtatggcatcgtccttgggcggcgccctcatctgatttagcacctcaatcggcaatgtctccggaaccctatacagaaccccttccacaccctccacaccctccacgcctttcttcaacctcttcgccagcccctccacgtgtccgtacatcgaatagaacacgatgaagaccttcaatttcgcgtagcccgagagcgacgacgctgcttcacgtgctggcgggtcgggttcaggcgtgtcggcgttgaccggaggcaagatcggcggcggcgtgggggctactgcggcatcggtgggagcgggagcatcgtcggcgaccggctctggagaggttccagaagaggaaagtgtggggagggggaaggttggaggcaaaatgttggagaaccctagattttaaaaaggacaacacgtatcaaaatatttaaaaaaagacaaatatcttcatagacggtttttgaaaaaccgtttttgattgacaataatactaagacggtttttcgaaaaccgtcttcgaatgatattttctaagacggttttgcaaaaaccgtcttagaattattgtatttatttacaaaaatgccaccgcgtcactttctaagtcggttttcgattaaccgacgttaaactgatgtcgttaaaacacctttttgtagtagtgtcgctcgaataagtcctaagcaattaataggtccttaggtaattatcaaaccctagattttgtataatattttctctgtcccacggtgtaagaagaaaaaatatgttataaaataattgttattttaatttataatttaatattaatttttatttatatattttataatattaaaaatataagctaaaaataaaataaaaattaatgataataaaattaattttaaaaattattattattattattattatcattatttaatttatatagattataatttaaaaccacaattataatggaaagaaatagatgtgcatgtagaaaaggcaagcttgtttgtttaatatggcttggtttgcagtagagagaatcaataatatggaaattatttattgtatgaaagaggaattgttggggggagaaggaatgaacacgaacgaatgagaaacaaagcatgcatgaaaatgatgatagatctgaaaaaaagtgcatgcccttattgccctcacctcactcaccgcataattggaattggacggtgtaaacagcaactaaaccaccgccacagccaccttctatcatcaatttgcgtgttgcttcctttattactttaataataatcccataaccactttcactttcttaataacaagttacccaataaataagaacgagttgtacttgtattaaatacttgtaaaaatatatataacttacagttttgtctgatctaaacggattggaattctctttatttattagaatttttcagcaagagatatataaacacaatcaatatcaaaattatgttcacattttttaagtatatgtttaacttattcttcgtgtgcttaaaaaatttgaacatgattttttgttatttaaaaatcaacataattaatattgcactttttttagagatgattttgattatatattttaaactataacatgcaaaacttataaaaaaaaacaataattaaatgagtttttatatattatatcaataattataactattatgataacgatatttactttcgtctttacatttttagactattttattttttactaaccggatattttaactgtatattaaaaaatcatttcactaacagaaacaagcacactctctttttctgtataacctttttcatttatttttaaaaataagagacacgaaagtaaataatactttgtttattttaattttaacattgattggatattgatatattcttaatattaaaagaaataagtatggggggagggggaatattcaattattggggctctcactttcaaagttttggtgattttgatactgtcattgatgttttgggtcttccttaattaattgtttcattttcaatttttctttgcagagagagagagaacaatgcaatatgcattagatcaataatacatacgtatgaatctcttttattttaaattttttattttttttcatttctcatctcttatcatgttataaattttattaattttttttctttttttgcctagatgtctaataacatatcaaatatttttctatgcattatgcggtttatcacacttcccaatcgtacacacgtgaacatgatgcaatgcaacctatctactacttcggctttatgctgaaaacgacacccatctttataaattacacctatgcaacttgccctgttaaagaatgtgacaccgtcaaatactatcattcaattatgttaatcaaataaactactactcgatcgttctaagtttaatttaagcctattccaaatatgtaaaatcataagagacatcaagtcactattcgatatagttatacagataatgttttcagtatcactttaattcgttttagtaagttgttaatttatggattcatctagataacgttttttaaaatatttattaaaaattataaaataaaccacacttttgagtggttttaacatatgttaaacttcatcaccagtctactgaaaaaatatttttttagtgagtattcttacgatactgattaaagaattaaacaaagattttttttaattgtatgagagtacatttaaaatttacatataaactcatttttttatcctagttagagataacatatctcctattaaataaatcagtgaattatcccgcttgtactgtataactgttggcaaaagaaccaaataaatacaaattaaataagaaattacgcatttggggcaactttgaaactatttacgcatctggggcaactggtcacgcccagaactgggcgtgactggtcacgcccagaaccaggcgtgaccaggggggtagtcacgcctggttctgggcgtgaccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgtttaaaaaatacgctttgatcttcattttgcttctttccccagtttccctagtgttctgattcattcttcttcttcaccttcttcatcatctcatgctcataatccttagagtaatcctttaatccccgcaaactgctctctagaactggcgaaactaatgcaccaaagcacttgtaacaattgtgatcagcgaggacattggtcttattactgtccttccaatgtccgatgatgacgtattttatgtcagaatttttacaaggacattgtgatgctcatataatgtagatttgacgatacatataactttgaacagtcgtaatttttcgtatcaatgtccgatgatgacatattttatgtcaaagcgctcgaaattaagagaagtaattagataaacaaagaatggattgcaattcaccgattgaatagataaaatatcaaaaaacgaaaaattttttagggctccgaagattaaaacgcaaatttgagacacttagaggcctcttttggaaaaaagttttgggcaagtcccctttgggaacttgccagcggcttctcctctcaatttcgagcgcgtggccaccggtttcgcatcaatcggacgtcccagtcaaaagttatcgccttccgtaattttacgaaaataccgcgaaaaccctgcacccccattttttgtgccacgtgtcaccatgggagcaaaactggtcacgcccagaactgggcgtgactggtcacgcccagaaccaggcgtgactacccccctggtcacgcctggttctgggcgtgaccagtcacgcccagttctgggcgtgaccagttgccccagatgcgtaaatagtttcaaagttgccccaaatgcgtaatttcttatttaatttgtatttatttggttcttttgcctataactgttgttagtccaaaaaatatttatataagaaaaaaattaaatataaattttttattaaataaattattttttatatgtgaatacatcgagatcttacgtcactataataatattatagttgagaaatatatttttacatattctataaaaatattttttttttacacatttttactttttccgatctcaattttacttaatcactagtttacaactactcatagttcttaagggttgtcttgcaaccaagccaatgttaatagtttaaatgaaagcaaacctatatacacactagtttcattaaaatttctttttcaaaaataataataataatgttccttttgtttccagcacttcctaagttcaattatatagtatcatcaatcaggagttcgcataggccactatgattctcaaaagacgaggaacatttaagaattatagtagaacagtattgcactgatatcttgtaaataattaaatacacccaaataattaataaggatgtatgatattattcattttattttttacactataatattctgatcatgtcattgatttctgatacgggacatatgagacgtataacttagtggcctgtatgtataattttccccctcgaataatatggctgttatatagctaggcaacaatcgttatcattgtcaaaaaaatgcacaacttccctttgatttattaaacaaggtacgattattaagcacttaggccttagctagactaggaacaggcatagctatgattttaagcatcactcactactttgtttagggttcatggtggagataattcaggattttgcttattttattttactttttttcttttgaatttctaaattgtaattcttttagctttgaatattcgttgatttctagatcctccactacctcgcaattgtagtaccttctagcaattgacagttgatacacattccacagatctttagatattgaattcttttgattatcactttcttttccttttttctttctttttacttgtttaatcttgacacccaaacagctcaattaacccactgaaatnnnnnnnnnncattgattcattttcaagtgtattaattattacttttttaattaaaatatattcttactttattgtcaatttgttaacacctactcatttttcacgcaattgaatgcattcctcggcctattgatcatataagtcaattatttgcggggtgagagaaattatctattgcatatatgtaatgttatatcattaaatataattattactccaacaatttaattctatgagtatttctagaataaaatttaatttatattattaataatgactaattaacttaactaatttaattgatcttgataaattagttatttatttcttatataaaagagtataatttatttattttttacttaagaatatgactagctaatcatcacacttatttattttggtattttaattaaagcttaatcactaataaaaaaaaactttagataacacatgcacttttatttgccatatctagctaatcatatcatgatatcgagaataacaaccttgaaaatagagtagtattttttatttgtacataaatacacaaaggacttttgatgattggcaaattgtaaagccaattaaagaccagactgtaacattaaaagggcattgtcatttttccttaaatgattggtataatagagattagataatttcttcattaatatcctaatccttaaactatttgatggtaaaaaggttataagtaatctatgattcttcctaacaagtactcttaattctttaactaaaaaaattcacagtttttttatgcattgcctttttctttgacttggttggaccaacaatagtaattactttgtgctgatgatagtagtgctcagcattttcagtttggaccagatgtaacaatggaaaatcaaatgggagggattggtacacaattgtactcacgcaacattagagtcaagaagtagtgccgtgaccaagcattattaatttaagggattccacaaatgtcaaattaacacttaaacgctggtgacttttattgttattccttcatttttgtttgtgataaaactaaaaagcaatgaatgtagttgagtagtttctgtcctttgagtgtggtcaggtcaacaattggggttggatcgagagagtgaagtctttttctgtcgaattgaatttcaatggtggataatgctaaagcaagctcaccttgttagcacaaaattagtagtcctacaagtttgacatatttgaaaaaaaacattttccttggtctatgaagtggacaacgtggctcaatgggtgcgatcacttagcacaatagggtatgaattgtagtacaaaagtggttcccttgggataggcatataatgtttcacaatttagttggcattgagtggcttgtgaaggtaaaagtaataatgctggattagaacttgtaagttagaattttcatcaaccaagcaattgggttgataatgttgccctttgggtgcataacattttcaagagaaacccggaaatcttatctaaatgcacatgcatggttaaacaaaaggccaaattgataattcacaatgtcactaaccgtaagctgacacgtcctcttttagagaagtcgcttttgtgtgattagtgtttttttcccccttctttttattgtattacttttcattttgggtcatggagcaaatgatataaacaaaattttcatttcttcatgttgatcattagtgaaatagaaagtatgtatatatatgatttaagcatatcctctttggttaattgcttagatatttccacttagacatacaatcttttggtgtttgtcccctaatgtttgagcatctcatccatcaagcccccaccacctttgaactcaactatcccacacatttgtccatataaaattatctctttccctatctatgaatgtgaactgtatatgtgccagatgctaaaacagtcaacttacatttctagattattattcgcacttttagttggtccctgtgaattttttatatataaatataaattgttcgtgtgatttttaaaatgagtatccaattgagcactgtatatccaggcctcttaggcccaatctttctgccaaataaaatccagtaatgcaggatttttagattgagtgggattgggcttgaacgtggagtttggggttgttgcttcctgcattttccaagttactttctgcactcttttcggaatatttttttgacctccgggataggtcattttggaagccaaaaataaagtgcattctgaaatgtaattttacattctggaaggtaaaaattgagtgtaggaagaaatagcaagagtaatatctacaatactattaataagagttaggttcttgatctgtaaaaaaaagagagtttgattcttgagcaatggcttagcattggccacttcttcccgcaccccaacaatcacagcctacataccttgtaaattctagattagataattcggaatataaaaccttcattttgaattaaccctttcatagtaaaagagggtgtaaagtgatattattggaggtgtatgaagaagagacccttaacaataagcaagagaagtgaagggtttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaaaagaaaatactttaaaagtgttactatgttttcacttcttcaaaaatgcaaaaaaggttgatttgttcttttcaattttggatatttttttcaaatattttttaagaaaaatgtttactaaattttaaacaaacatattttcacttttatttaaaaataaaaactgaaaacgttcaaaccaaatgtgacctaagtcttgcatagagaattcttgatggagattcttagatacattaaatgtaagacatgagattttagatgcatcaaatgtactttaagtcgattcaaaacctcataaacgaaaacatataatgaagcctttaaagaattgaatgacttaataatagttaacacactaacacaattttgttctctttacaagttagtttatttaatttcattttggcttgtaagtttgttaggccaatatgattataatgtagcggaaaaataattccgcagccgggattggaacccggaaattcaaatctgagaatttaaccaaatacgctactgcggatttgatgatattgcacccaaattgtgtaatttattatataatgtttaattcgaatcatatgcgtttgctttagaaaatttgctaaatcttggtgattataggaggaaaaggaattaccacaacaattagttgacaattatgagaaattgtaaacaaatatcaaattgataggattaaaagaaagtgatttttttttaatatcaaaagcggatttttttgtacgatgaaaaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaataatcacagataaattgttccccatctttctcttataataataatgatttatttaaagtttaggaatatatttaagacatagtacgattaatttctttaagttatttagcctgttaaaaacctaaaaagtgtaagtgtctagtttgtattggtgaagtctcaactatatgtatgattttgtgttgcaaagagactaaactttgcgacttgaaaagctatatactgtttacaacggttgaaagaagaattgcacccattaagattccaagatacaaatgcacaccaatttttttatttgaacataaaaaaatgtaaaataacattatatatagtacgtatatatgttagagttagagattattatttttttacatgaaagagtttaattttatatagacggttttattgtataattcaccgtataattttacaccgccaattaattagaaattatcattaacataaattttaatttattaattattataaaaattaataaacttattatattataatttatgattaaataatataaaaatattttacactatccatacatacattatttactcaatatattattcttatatacaacagtttttatacaaaccatttttaaaaaatatttattacataacgtatttttttatcttacattcctttttttgttttttatttcttttcttatatataaaagatgctgtgagaagatattataaaaataatgtattactttatataattatttttatctttaacttttttccttcatatatacatgtctaaaaaaatacacttcaaaatcaaagttgaaaaaatattgtcattcatttgaagtattgcaggaataattgtcattttgtagtcactattttggatcctttcttcgtggaagtgttggaattggctccccggtaaataatgtgtaatgtgttacataaaaggggcagcaaccttaacatgttggtggttgttattatagtaaaacaaatttatatgattatattttttttttatttgtggagattaaaaatagtctcaagaggatttacaataactcatgcaccttatctaattaattaagcttaccaaaaaacttattggaaagaaagaagaaaatagaaaaaaactaaaaaatgattaaaaaaaggtcactaattaacaagttatttttatttttgactccagaataagcaaacaactgctttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttcttatatataaaagatgctgtgagaagatattataaaaataatgtattactttatataattatttttatctttcactttttttcccttcatatatacatgtctaaaaaaatacacttcaaaatcaaagttgaaaaaatattgtcgtccatttgaagtattgcaggaataattgtcattttgtagtcactactttggatccttccttcgtggaagtgttggaattggctccccggtaaataatgtgtaatgtgttacataaaaggggcagcaaccttaacatgttggtggttgttattatagtaaaaaaattatatgatgatattttttttatttgtcgggattgaaaatagtatttacaataactcatgcatcttatccaattaattgaatttaccaaaaaaacttattggaaagaaagaagaaaacagaaagaaactaaaaaaatgataaaaaaaaggtaattaattaacaagttatttttatttttgactccaaaataatgctttttttttcttccagaaacatatcatctactagaaaattctaaagaaacgacaatcttgttaatctgaacacaagcctcttctatacaatgcttctcttcaaatgtcaacaaaatcatgaatcagtccaatacaacatacaacattaataacatctttaactcaagttaattggggtcagtacaaaccttgtccaatacaataagctaaaaatcatcatgtaaagttctgctgactatgaagtactattcttgtagatcaaggttacctgggtgcaatctctttttgccacaaagaggaacaccaaagagcttcacagaactattaggctcatcactagaagttaccaaagacttctccgtaatccggctcttagctggtctaataacatttggtgatgaatccaattctaccagcttcagaatagcacttcttcttctttgttcatcataggaagcaggacttacatggttttggatgaaatatatgatgtccttgtataggttcttcatgtgagtgagttctgataagagcatgaagttctttctcctcagtctttggttgtcctcagaaagtgctgttaagatgtcagtgcctgatttaggagatggtaatgggggagtatcaatccagcacatattttcatctggctgaagaagatgtggtggttggtcatgcatgtggtagtgttgttgatagtggtgaggggttttcctcctgtggatttcacatagaagatgcttagctccttttctgaagtattcatttgcaaactcccacctatcagcagctaccttcttgaaaccctgaaaaagaaaagaaaaggaaaggtatatatatgtgtgtgtatgctgtttcacacacatgagttaatcatgaagcttgtgtagctagctaggtaatcataagttagtcttatagttcaaatagtgaaggaaaatacttttgaagtttttatactataaaagattccactttctaactcatctgaattagtattttgattaggctaactttgtcaagaagtgtagcacaaaaaaaataatcttctctgaattggtaatatgattaggctaactttgtcaagaagtgtatcacaaaagcaataattaaggatagatcagaacaaaaaaaagttatatatatagaagagatggattctcacataggtatttagctgcctaacaaagcttgagaagttgttgtgcttgaaatagttgggaagaagatctctagcaaactccgggggcctcttcacaacaaatgtagtttcatcatcaccccaagagacaatgtggtcagtgcgagggtcatcaacaagtttgtatgtctttgttagaaagggagcaggcactgacttgagagattccatagtgaacaccatgctatcttcacacctgtctagtgtgaaagccatcactgaattaccaaagagggctagctgcttccaatattattctttgatggtactctccttttcattcacttttttcacaccaccaagttttaaagaacctctctcactctatcatattataatttgaaaaatgatgcatggacacttatgtgctactagacacttagacagagatagagacaaatgaaagagaaaagtaaatatgatggttaatatgatgtgataagaaaagatagataaaagaaataaaaagtgttcactaagtgtatacactaactatgctgatattcatatatcattactcttataattttacagctttatgcaacagaaacatatgacatatttcttaaataactattctttgtcctaccccctctattatgtctgttgtttactaaatttaagaagcatatgaccatgtctgtaaaaacaatgtatttttctaggataggatataattaataagattcaatgagctattaattagctattgattgttttctcggatgcaatagtggtgggttgtgattcctctagagatgtgagctacttactattttattttggaggaaaaacagtgggatatatttttataagatattctccaaaatttggagaggtgtatggggatatattaatcaaaacttaaaatgtactgagatggggttgttagatcatttcatttgagtttgaagttaaaaaaatttgtaaagactgcataatacagtgattttttatggatacaaagatctcatgtcctctgcaaattcctagaacaataattaaatagaaaggtgatattttaagtatttctttctgtataacacatactaatagtgtggaactgaaacttggaaggttgcgatagtcctccaacttaaagagaaaatacttacttttatgtatattcattggcccactattatatatgaatgtcagaagttgttcaatttgttggtccctccctctcctccaccctcgtctttacttggaaactagaaccaaagcctgctttgctatatatttttttttccaataaaagacgaggtattctcaacttcgcatgctttttggcatctgtaatagagaattaatttgctaattggactgatctgttttgtattaaattttaatcatatatataagttccccagaatgatacctatgtaaaatttccatccaaaatgaatacttagaagccagaaaggaagtatatgactataaggaaacaagccattttatttttgaataatgattctttcatgatacttgaatgttgaaacacatcactatacattatagataaaaaaagaagataaactaaactataaaatgttacatgaaactatatgcatatggcactatttttaatttttcatcatcagatattcatatctagcaagatcattcaagattatcatttacacataagtgaggatcagtagtactgttcttccttctttggtttaatctcatccatgcttcaacaatcccattcaaataaagtactaataaggattgatgggatagaaactttcttagatcacccaaatcatgactttttgatttccagcttgagaaaagtagtgtctcagaaaccagaaaagataaacactgttcaagaattatgtggttgtaattttcctttttttttcccagctatcatgtccatcccgccctttattttctgaagaaataccttttcttcttttatagggatatttgtggggatcactgttgggttgtgatcacgaggatcaccattttaaatcttttcccactacagctatatgtcaaagtttgcctcctgtacataactacagaacataatagaaataaggctattatataaattgtaaacactcaaagtgcttcgtacctagttttcaaggtagaacattctgacctttattcatttttgtacaatccaaagcacacccgtgacctggacatatagaagatgtatttccttctagtcatcaatcatggaataatgtatttatatatacactgcacaattcctatataagtgaatcttctgtaatttgaccagataaggtgtatatatattaatttcaattttcaatgctatgcctaattacattagagaaggaagaaaatgttgtgcacaaccttctagctctggattccattgttggagacattcatcactttctttctagtttgtttctttcttaatttccacactcttcttttctctctcgcttttgctttgaaaatgtatgtgttgaaattaagtgagatacttagctagctccattttctcatccaagcatctctttttgagtcttgaatttttggtggtcaaagtatagctaggaagcctctaatataccctgcatcacactgctaagaatctgaaaggtccacataaatatctcaataatgagaagattctattctaagttaatattaccaacacctacagtttccagtaaaaatgggcaatatatgttgttgcatcacatgatctatctccatccatgtgacccactgcatgcctttttagatagaaagagagagagttttgtcttttatgtatcatgcacaaatctaaatgcataacatgtgaagatcagcatgtggcaactaaattaaaatagagaagaagatgcttccaaaagtgactattattggattaattagcaaaaaggggaggtttgaaagcttagtggtttttgtaaaagttaagaccgaggttaaattgcatgatttctcctttgaaatttgaagaacaggaactgtggctcttcttaaatatatgttcgatctttggaagttcaagagctttgaagaccaataaccatactttttgtttttgtttacgctaagtatctctgaaccgatagtcagagattaaattccttcgaaatgtaaaaatcaccaaagtgaatattttctctccaaacaaagtcttttatatacttgaggaattgaaccccttataacatgcacccacaactgtacttttaacggagggaataaacaatccttacaaagaaaaatgatagctagctataaccgtcaacttaatgcataaaaaaccattgaagtttattagcccaaaatatgattttgttgatcaggctcgtttgcatcatgcatagtactacatatgcataattaattctactgaactcagcttcattatttttcaaattcagttaaacaaaacgaaacataaactaatattttaagttgtatatgatgtggacgatgatatcaaacgtttgttgaggaagttagatccaattcttcttttctttgttgtaataaaattaagaaactaaaagaataaagattaattagcagtagtttaccgtagtcgagaggccttgagtcatatattctttggtattgagaaaatttgaataatatatcaaaatttcattcttttccttttgttctttctggtgacgttactaataaggtaaacattggcaggaatgtagataatacaattattcataataaaatagaatgaaaaataatgtgtcaatacatatatcatgtgtggtttatattttatatatactgcactggcttttcttacatatccacatccttagtggacgagaaactattcttttttctttttttttgaaaagaaaatcttagtggggggttctgatttgatgttttctaccttaataaagtcatacgaatcatatatgtgcttcctgcgaaggagtgcttcattacaacatgaagaattcacctccacatctcagccaaatgatgaaaattcacatgcgcggagggcaatgcaaacaagctttagtctatcaaccatttatatgtaaagtaattgttcctattacttggattttggcatcattacctctcatgcatttgtctagccagtggtgttacgttcacactgtataactctcttttcctattaactaggtcccatgtatataaaatattattttatcgcgcaaaactttctttacattgaaaaagtatccactggaaaatactatatatgtgattgattatatatcattattcttttaatttcattatttttaattacattgtatatatgcacatagttgcattcttcacgtaaaaatgatgataaattggtgtaaggtggtaatgtaagaaaaataaaacggcactaagattaagatatgttacaatattattgtttctttattgaaagtggttttggtttagaatatgactaaagaattattgtcagaagcagtaatcacaacaccaagcattttcctttctctttttctctgaagaactttgtagtatacctaggaaagacaacaatttaggtcaagcagtgtgcagaaagcaaagagcattagaaaaattcagccatggtcgtgtatttaaaagtaaatggaaagggcaatttcataggcttttaacctttcgctctcttccatgtctgcatgcatacattttgttctctaatctttagcaacttaggtagcaacttaggtaccctttgtttccttttttttttttttcccctcgtgacggtcaaagtaaagccgtaatgcatttttgcaatgcaaagtaggcatgccatttaattcctcgtgattatcaattgttcgaatttagctccgatgccaatattttgatttttgtacgtttttaattttatatttaagagtttaacatataaataatttatgggctacaccatttggagacgggataaaacacttgactccttttttcctttcttgtaattttttttcttctaaaacaacattagagagaaaagtgaagacaattaacaaaagatgaatgataatatatttagatcctttccttttgatatattcttcattatccacccgtgtattaacataaagtcctcacactttggattaaaataatctaatagtgtactatctttagatatatgatttcatcatcgctcagcactttatatatatatatatatatatgaattaaatctgttacttatacacacaaaaaattatatttaggtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgtatattccttgacaatgcataattttaaattaattatgcataatatcatttataattttaaacattttttcctttcaagttatactttttaaattttatctatatttagaatatttgtataatataatagaaactagttggttcctgttgaaataaacgctcactttatggaaagtaaatttatatttttgcgcacctaaactacaaccaatttttaagaaatttgagccatatttgaaatcaaattacaccttttttggttaaataattttttgttacaattcaacctctgtaagatacaaaatttattttaaatcatcgtaattcatatgcattttctattttcctttctttttagttttgacaaagtgcatcgccatttaagcattgacgtgttagcaacgggaagttgtactgctatatagcgtcttagatttgtgttaaaaccagtagtacaaaattgtactcttaacggaacatagatcccttcattacaaataaaagtacttcggcgtagtacatctaagcctagaagtaccacgcttgcaaaggctatatatatccacttaatcaaattggataaactcatcaaattgataaaacattattcaaagtccaatgttccagtttaggcaaagacatttccaatatatgtggaggtagagggttctacagggtcgtcctgagaccacatgaagcagattcagattacaagcatatttgtttgtgatcttttatgtgactcagctcatgtgttctcaggtcgcccctgccgaactttctctaccatgatacagcattggcatccaattccaatctattgcgaatgcactcagcacaaatgaaaatggagaagggcaaaagaatgtagaatgaaattcctattgcatgaatgtggttcaggtaattaagctacaggattatctatgtttgtggaattgcatattttaaggccagccatctgttatcttataggtaccataccttataaaagaaatcaaacaaataataataaaaataactagcatggattaaatcctgacaagaactaagcattaagtataaattaaactaaaatccttacagaagactcaatgactagtagctcttcttctgtaagtttcttccaacctccgcctaccatgggacatcctttctccccttgcaatggcaattcattgtttaattcactaaattctttggtctccctcatcttcttgacagttgaattatcaagttgcagaagatctaaaaaggcatctctcttggcaccatgtggggtcaatttccaattctcttccttttctgatacttgattctgttttgcatcatcgataatgtcatcaacaggaagacaacaagatgatacttgattctgtttttcatcatcaataatgttaagaacaggaagacaaccagatgacccaacagcacggggcaacatgccaattggacacgggttccatgattttgccaaagtccaagtctgtgattttttggtgtcacaatccattgccattggttttttatttttcattatctgttgtttaactaactctagctttttagctgcttcgagcatggattcctcaaattggaaaatgttctttgaagttaataaagggctttcatcatctgcactctctaaattggacagactaataagagagaactttcgaattttctccatcaagtagctgtcgttcatcagctctgcaagctgaagtgctgaatccacgagctgcttgttgaaaagttgtgatactagaagacatctacgaagaagttcatgcaaaactctttttggcatatttgcttctgcagaaggaaatttactgagaattccaacaagccatgcaaacaaagaagaaagccaaaactctgttctcgagtgtgaaacccccatatttgggttatctacaaaaattaaaaaagaaaacacactatgagaacaataatgaagaaactaagcgtaataccaaaccaaaatgaaggacaagagaattttaaaactcaatatctgacttcacgttggctcaaggcagaagaaatactaaagggaatccaatcggaaaagactttccattagtagtgcatttaaaaagccctagaaagtatctggcatttaataagtaaataaatggggcatcaaatgacaaaagcacacaagaaaaatacatcccaagtaccccaaaacaaacagatattaaatttcaaccagaaactatacataatgaaaagggatactgtagaaggaaaaaattgctaccaaccttctttatacttcatatcttcccgactctcaatcatatcaaggacttccttaagaaggttcagaagtaattctggttccttattgcacaatttgagtatgacaagcatccaatcagccaaaacattctgagtggttagaccaattgaagcatcatctgcattctcttccaactcggaggaacttaaagctttcaacaaatactccaacaacacagaaacaatctctttggaaaaggaggaatataaccgaagaacatatttcaagatctttgcaatttgtttcttagatcctgaaagtatcacgattcactagtaattatacatgaataccctgaaacattaagctgaagatactctaaaacgaattatttcagtttcacttatttttcatagtaaaataaaaatatccaatatctcaggttaggaatctctcatttatttggtcgatcagctttaaggaaacccaacacttgagttttaaagaaagaaaaaatagaaacataaaaatatgaaatggccaggaatcctcttaaagcagaacgaacacaataaagaaagaaagaacacccactaacaaggtaaaccaatcttttagcataatcaacataggaactctcaaaaaccaacctgtgatttaaacccaacaaattggccaagaaaacactatcctttaagagaggttaagtagacacaattggtgttgcatcctttcttttctcttttattttttgttatgtggcctttagacacaatttacttctcctttaaaggatgacttgcccttcatcccttgcacaccattaattgtttcatggtttagttaatgtaaaacactcatacgaatggttaaggatgagagtgtttttgtacctataattatttagcttgtttttttagtatatataggtgcaagggatttgtaacatttaattcattaagagaaaacataaggatacaaatcctttagagagcacacatgtgagaaataatgtgtgaattatttattgttgtgtcatctaagaccacacaaaatactcttatttatagtgaaaatcagcagggtggtttgttttagcggaagaacatagacaacgagaaacaggtttcagcctaggctaaagtttaggaacgaaaacctgctttgataccatgtgtgaattatttactgtcgtgtgtcatctaagaccacacaaaatactcttatttatagtgaaagaagttcacaaaataaggaaactaaataataatgagtaataaggaaaataatctcatcctactgtaattaaaacatatcaaatcatatatttcctaatcctaataaaggaaataaaggaaacaaataaactgatgatattcataataattagccactgatattccttgattttctaccgataaagaattcatagagaattcttctttgtaattttgttcttttcttattaaagaaattcttctttagttttgcacagtataaatttctctgtctgggacagtttttcacaacaggtatactaaacaaacacaacaaataagttttattgtaataagaaatatgaacaaaatgatacctccggttcgagatgtttgactcttgccaactataagagacaaaagcttattacgcccaaaaagcaattcaccatgcttgacccctttaaaagagaaaaaacacatcataagaattgtaggaaaaatatgcagttgaatgtcatcttaccaacaaaataacccatactgtcttgacttagaatacatttgaatatgatactacaccaataactctacatccattaataattgaaaaatgccttgacatgtgctaccattaccatatactaacattaccaataggctccactttataatgggccaaaggatttccaaccatcaaattttcaaatgggctttcaacattaaattacatgctttcccatgggcacaagttacatgtacataaataaaacggaaaataggaaaacacaaaatagaactcttaatgaataggtggaaggaaggtatttgacttaaaataaacaagtgcaagacaatgattaaagtcacaatatgatcaaaatgaacaaagcttacagacgttttgcttttagtagtgaagaactagactgagcactcccattgactttcaagcagatagctaattcacgaatcttagacttaatttctttgttgacttttgctattccttcaccatgaaagggaattgctttgctctgaggttcccaataataagattttaaccaatcaagtgcctgaaattattagcaaaacatcagatgagtttggggagtgagttaaacataattagtgtgacgggaatagccatacatgttaagaacttatgaagaaattgcccatattcaaatagctaaatccacaaaagaaaaccacgatgctttccatttttatttccagttacattttaacaacaaactgaaatttcatcagaacgaaaaatgaatgtacaacagtaagcgagtaatctaaaagttattacaaacagaaaataataatttttctgttgcaaaatagcatagatttcagtgactactatgcatgtactctgtcctttgataccattaaaggagaaacatgatttctatttcatatactaaaaaatgttatgttacacacagactttgggaaagaaaagttcagtctaataatttcgtgaatgctaagaatgtaaccccaaccaaggaccacacacacttgctaagaatttaattacaaaaaagcaaaaagattgttgagacagatgatcaaacaaaccacgaaatgagtcataccttaacagaagcactacggacaatcttaagtgaaggaagctcacgatgtgatccctctgcaattacagcaataaataagacaaaaagcagggcactataaacacaataaaacaagcaactaagtgaacttctttgactacaatgaagatcgtgtctcattctaccagcacaacaaaactaataattaacaggagtcaaaagaaaacttgttcaccatggcgaatatcaatcagcatgcgtggaataccaatcgcatcagctgccactgctatcgacgccacttctttcttgcgtgtcttctcaacaacacaattcacaagccttgaaaaatcaaaacaattatactttaaaatagaaaaattaaaaaaaaaattattagtgagaagaagaaaaaacataaaaaaaggtatagtgaccactgagcaaacctcatgatagccatacaatacagcatagcaagcatctcctccgaaagagaagcttcattccattgatcatgtctacaattaaatcaaacaaaattgcttattgtgatagtacatatatacattgatacatacatacatacatacatacatacatacatacatacaacatacatacatacataaggaaaggagttagggttacctgaaagatgggtctttgagttgaatttcgatgatggaagcagtgacttcgatgagaactggcaaggaacctcgacttcgccatgcggatatctgagggagcagaacatatggttaggttaggtttgcagttacagtactatgtctatctatattatgaatttgtatggttaagaaagttactcgtttgagaccggaggaaacagagtgaggagaatcggagaagagagcatttttaacaaagagccactcatcccagttcaaccaagggaccaatctatgtgcgcttgatgacgatgatgataactctgtaaccaccttcgcatcttcttcgaaccctaataacaatgccggctccatcccgaacgtgcttccacttctgttctgaaaatactgagtgaaacgccaaagcctcggagctcgagggttttgcgctgtagtcgtaagaactaagaaccttttcttttgagaattttttttataatttatttatatcttctgttcttgttttctaaaataatttttttatttataattttttaccatttaaaaaataagttaaatcaaagtaaattaaagtttaattatcgtctaacccaattagttaaatataatgcttaagttattataaattcctaattaaatcttcaatttctactaatcaacaataataaaaatttaattaattatttggtctctatgcaaacattttttattttttatgatttaatgcttatatcttttatattataacagcacaaggattaaaacataaaatttctattgtagaaaaaaaacataatttttttagatataaagacttaattcatcttgacttaagattattcaagtttaataagagacttttcatttgaatcctaaatatacaattgtattaaatatttatgagaattgttttgctgtctataataatcactaaaactcaatgtgagacaaattgtaggatccagattaattaaacagagaaaatatatttagattaaaaacttattttctgctttcaatagaaattggatgcaataagaagaatgccatacagcaggttcagttcttagggtttagcccaagatatacggtgaaccagggagtcaattcaaggcacattttatggtggtgctacccaaatgtatacactagactacattacaatatttctaacactaatttccatcatcatctatggaactgaataagaatgctcatgcaaatattctcgtaaaattgaccataacgtaatccaatccaataaattccatgtggtttatagctattatactttggatcatcatactttaccatttccttagaatacgagaccgacacattaaataacttcttgagtggtcatgatactaatatcttcttacatataactactttgagttttacagtattagtttaatttcagatcctccacttgattttcgtggtagctaaaactattgtttatttttctccaattgcttttgacacaatctatgcaactgtacattagtggaaaagataaaacaaaatatatttatttttctttatttgcacagaactggattaacatcttggtttttccactatgtcaaatgttgaaatttgactaaaaaaggatatcagaaattttctaagtgcaggctttggctcgctttactggggcctgaagggaatttagataaatggtatcctttttgtccagtccatcaaacagataactaaaaggtggcatttggatgtatctcccagtgccaggagtgacctttagttcattattttcccaaacaactcttcctcctgcaatagtcacttcaatttttccctgagaaaaataaaaactttgaatctggatattgcatgacaaggcttcaattgttgaacgatacacaaacaatcacatgttgaacagattataggtaaaccggtacctttcctcttcttccctcgtagacatttgtgtccagtctggagtggtgagactttgcactcatctcaaagctcgaatttggattcaggatgataatatctgcatcagatcctggcagaatagctcctttccttggatatatattgaagattttagcactgaaatgtttgtagaaatgaaaaacatcagtaatactttgggcatctttaccaaacagcttttttattgccataagaactggaagctaatttgcactttgattaactgaatatataccattcagtgcttgttatcctgacatagtcagtgacagatatttggccagattcctgtgagatatataaaccataagttctagctaaaaggttatgctcttcaccattttaccccgacctaaacagaaagggagggctaagctgtaagttgacatcttaccaccatgatatcccataccaaatgcattctttcttcaatacctacaggttgcattctatatcagtaaggaaacatttcaaaatcagcaagaaagtatttagaccacaaatatccaagactttcatgtgattaccattgacaccattaggcattttccggaagtcatcgattccacgagctttttgggtggaattaaaggcacaatgatcagttcctaccagctacaaattttaaaaaggtatcctttggtcaaataaacaatctaagtaaaacgaataaaattgagctgagggcagcttgaagggtgtatttcatagctgagactatcctgagaaactcaaaccctcatctttaattggttattgaacctaagcctgaatcataatgtgaaacctgcaaaacgccggttgaaagggcagcttgaagggccttatcatgtcctcgtttcctaataggggggctcatgacatacctgaaacatgagaatgaataaggcttatatgttcttaaaattcaaggaaataaaagaacaacaataaaaaaacattgaaacaagtgaaggcacttgctttgctgcaatctcaaagtcaggatgccaaagccaagattcatcaagggctaacccagaggcaataggctctccaattaccctttgtcctgcagcacaagaacaggttaccttattattgcaaaaactaagttatcaaggaacaataacacttcaaatatcacagtggaaatgtgtaaagatccttttgttcatcttcattgagattcaggttcatcagtgatttttttttttttaggactgcatggaaagagggaaagtacacctagggatagaataagtactcctccaaataagagaagtacaaaacaaggagataggaaaaaataaagacaaagcagcaaggcaatccagtctctgtgtatcaaaaatagaatcttcctcaggaagctcttatcacaagtacaaaacagcaatcaaaattaagtctcagactctcaattaagttcaagtgatttgagttgccctcagtttctacactctatgatagagtagagacaacagtaaaacacgagtggatttataaattgctctcaagttaaccaatgtatggatgttataaattcaatcaaaatgtcttccttttgcatttctccctaaaaaagattgcaagagtattagtttttcttcaaaaggatttccaattttataagttataaatcatctactttctcttaatgaatgtatacattaataaaaattgagactaacacgagaaatattgacctgattttcgggctttcgcaatttcttccattgcgtcaatgctcattacatgaaccacatataaaggagtattcacaaaatctgctaagcgaatggcacgagcagttgcctctccttccaactgcacagataacaaagtcaaatgggagaatgttctataaatcacacagacagacatttaaactttgcagtgatcacaaaatattagagaacaaaacatgtaatcaagatgataaaatactggctaaacgtggttaatgagtttatcataacagatgaaagctgaacacaacaaatgtcaaactagggtggtcacaagcaagcaaaatttgatagtagtagcttaaaacagttaatttggctcaagtacagcacctaaatccaattcattatgcagggaggctactaagttgaaaagggaaattttaaatatgaggagtacaaatcacattcacatatgctataggttggtcagacaatgaagatgaaaagaaacaaaaaaatgtccaatattttcattccattattctgcaaattctttattaaaagaacaaaattgagaaattaccactgcaggccttgaaagagcatgcccctcaggaccagttattccaagttctatcattttctgttgcccttcatacacagcatctccattttctgcatggaccatggctacggcaccaagagacttgcattttttaaatccttccagaagaagctcatcattgatcataagaattcctttgtatgccatgaaaaacttaaaagagttgattcctgcaattacaaaacatggatgtactacctggaataaattccttacaactcacccaaagggttactaccacctaatcaaccaaattatcaaaatgcagcaaggaaataataaataacaacctttctccttaaccatgagctccatttctctcgaaacagtttcatcccatttggtaataaccatatgaaaaccataatccatgcaagacttctttgccttcttttcatagtcttcaaaaccagctgtcaaactcccattaagtggtataacgaagtcaatgtgcattgttgtcccaccagccaatgctgccgcctgaccactgaagaagtcatcaaccgttgcagtaaaaccaacatccatatctagatgggtgtgaggatcaatgccccctggtcagttaacaaaaggagcattcatagagtctatcaggcacataataataacaacaataatgatgatgacgatgacgatgataaattaattttcatgcactttttacattgtttaccaattaaaaatcattcgacttatgatttttttaattagttattataaaaatcatcaaacttagcatacatggcaatgggttgctccacacttatatatactatttttgtcatattgttagtcaacagggcatgaagtttacaaaattggacatttatgaagatctgacaacagcccaatatagggtggtccgatgctatcttaaatttgaggttgagataataaggtaaaaaatatgtatactatccacacaatctaatttatttatttttatatataagaatcgaagacagttaccaaggagtttaagccaactcatgctttctaatttaatctaacaataataggtgatgaaatataattgaataggttgaaacctggcatgacatatttgccggtggcatcaatgacagtgacgtcatctccaacctgggaatggaaataaatcatacatcagaaagcagaaagtaacaaaaacgcaaggtgttagaaagcaaattaagcactgttactgctagggggtttcaattcatcaaataccctgatgttaggattaactgcaacaatgatgccatcttccacgtaaacatcagcaatctggtggtgctgagcattcacaaccgtgccacccttgatcaacaacttggatgatggaatttcagttcccgcatcacaaaactaaatcattcgaaaaagaaaatcatgaattaagcatagaactattggaaataaaaatctcagttcagtaatcagtactaatgatcatacccagttaaaacactcaagaatcgaagctctaactctttgataacgtagaacgggataagtaaattagttgagcaaaggtcaacacagaagagaagtaaatcagtgtaacggattctacactgacattcacttacaatttttgtatgtgcggtaataagtttgttgacttttacaataactaacttaaaaatcatatctattctgattaaaattttgtacatcgatagtgcataattaaaatatgtaggaaaacgaagataagatagagaagtgaacctggttggattgtgaaagtgaagaggtaatgataatgaagaaggtaagagagaagatatgaaggaattgtgatgtgatactgaactgcatactgttccgaccagacacactcaactcaagtgtcggagttgctatctcagtcaacgaggagcctgttctgtttggatcgctgctggaaagaacaaaaaataagttgcaatggcggtgcaataatggattgtgctttcgaacacttcagttaaaggtaagtttttttttttttcttttctttgatggcttatatggtgagaactttgtttattttatccggaacagaccttctcattctcaacaaaattaaaggtaagttttttatttatttcatgttttaaaattttcctattagcagtttttgtgtctttttaaaatattagatatttgacatattttttatatatgatatgaaaaaactgttttagctctattaggaaaggtactgttttaagtataatctcattcacctaaggattgagttaattaactggagcggccaacaactactctggtctgagtggaattaaatccaattaccagagtggaattaaatccaattttattaaacaaggtagtcagatttgattaatatagtttatagatatttatgtaggtctcaaatatgtaattttttttattattattaatatgatattttaatcaattgagttaatagaataattatattaaaaataattaaaattgttatatataatactaaaaatttatatatgtaaaaaatatatgattaaaattaattattataaaatttattaaagtgttatgctaataatacgaatgcggcacgttcaagacttgcaatgcccataggaattgacaattattttcgatttttcctctcttgggtgtactaagaaatatgttagatgtagaaagaaaatcccaacgacactaaataaaccgagcccaacccaaacagaaaacaaactatcaggaaggttacttctcttcttctctctcgaattttccctgacttttgtgtgcatcgatggcggcgatcagtctccggaaagggaacacgcggctgccgccggaggtgaaccgcgtgctgtacgttcggaaccttcccttcaacatcacgagcgaggagatgtacgacatcttcggtaagtacggcgccattcggcagatccgcatcggcaccaacaaggacactcgcggaacggccttcgtcgtctacgaggacatctacgacgccaaaaccgccgtcgaccacctctccggcttcaacgtcgccaaccgctacctcatcgttctctactaccagcaagcgaagatgagcaagaagttcgatcagaagaagaaggaggacgagatcgcccgcatgcaggagaagtacggcgtctccaccaaagataagtaattaaatacttccttctcggaaaagcctagggttagggttagggttttcgagactctgtttggtggttatattgtattcttattattgttggatttagtataagtgactatgaattaatgtttacgatgctatcattatttgtgagaatgaaatgaaatataaattcatcggagatgcaatgccttgtggttgttagttaggggttttcgagaaactcgtctctgtatttatgtcgttgttcgagttgctattgaatactagtataaacgtttaagatcaattgtggcgatgtttcttcgagtgcgattcagacgccttgagtgaactgaattgaacattgcttcgaactctacaacgtaatttgtagtgaattgaattagtgttaatttcgttgatgttacgtttgaatatcgatgcatagctgaattcagctttagtttcaagagtggaaagcttatataatgtattatggtttatgcttctgccagcgtgagagagttagcaaggggagagagggaagaaacagagagagagatgaacaaaaaagagtgggatgacaatacaagggtaatttcttggttatttcttttgttgtattttcagaaatctgaagtggggggacttgaacattgttgctcccagctttttgtaggacttttctctttggtaaatttaggtttttcctttctttctcaatgttctgtttaccatctttgtattgaaaatcttgaatgagaatcaatgaaatttgtttctgcaagtcaagtgtatgaggttccgtgatggtttatccttctgttttcctaatctgaatttttttggtgagcctagtgtaataaaaatataaacttaataataataatgaatgtatttgaacctagtgttgaaaaggaatcagtagattcagtcataaataaataattcttttgatttgattcctaagtgagcagtgattacaatacaagatttgttgcaatgtttctcagcatatgaaaaggaaaagtaaaaaccaaaaccaaccaatcaaatacctagcatatgttaacatttctcagaggttggtttaagttttttcccccctctaaatttgtttgttttccaccttgacactgcttaaagagatgatgatgcctgttaaatatctttgcacagtccccaactaaaataaggttgagtcacgcctcttcttggtaccaacttctagggttcctttgttcatcattgcagcaaactcatcgtagttaatccggccatcctgcacagacatacaagtttttcagaatttttcgtagtcatgattcagatatgctgtacagtagtatgctaattgttaagcacatatgctatagaaagttttttgtattcaaactagagaagtgttagcaatgcattctttattattgattgcaatttattgaaaatcacataattttcttctgggtctcaattaatttaatgagtttcatattatgattttgtagttttcgataaactttgaccattaaatactttaatagaaaatgtgttagcaggagggtgccaacactcctcttagaactatgagtatttaattcatccagtataggacttacattatctgcgtcaacttctgaaatgatttccttcatgtccctgccatcattcatgttaaactcaactagtgcctgctctaattcttcaatggtaatgtacctgattatgacaaagccatgagattagaaccttcaacttataaccaatcaatttcaaaaaaggagtggctgatatatattcaatctagttgctttttctttacccgctgttatctttgtcaaagtattggaaggcagtataaagatgatcttctttgttcattcggttcatgtgcattgttgcggtaatgaattcatcataatctatggttccgttgccatcagcatctgcctgtaatatacagaaggaaaataaagaaaatagtcttaagtaatggcatcagagaaattactgatgggaagttattttgtcatatgcagtactttgaaaaggagatataacttacagcttccattaattgcttaacttcctgttctgttagcttagtcccttgttttgcaagcccttgcttgagctcttcaattgtaatggttccactgttgtcagtgtccatccccttgaacatctgcttcaatcccatgatttcttcctcggataggcagcctgcgataacctatactcatatattgatttcacatcacattaattaattaatatataaattttaataccacactatttcatgagtcttgtgatacagtttttcctaaacaatggatagaataatgttcgatctgaactcggccgatgaaatgtaagatttgatttttaaattcttttgtccgatatgatctaaaaccgttccggatttaactcacaaaagctcgcaaaaactgagcttgagtctgaagtaaattttagtttttctagcgcaatttattataatctgtgacttgcatcaggataattagtttgtttttccacttctaactagaatcacgatagtgtaaatatgcacgaagaataaagagaaagctaaaatagcattacccttagagcaactttcttgaattcgttcattgctctgaactgtttgagcctattcagtactgcattgtcaagaggtgtatctggtgcttctccatcctccttgatccatggatgatctgtttttcacataaaataaaaaagggctttattagaattgcattgaaccaatttgtctgggctaaagtaaaattaatttgcaaatcaataattcgtagttgaattcaagatgttcatagaaaggaagtcaatattatacgcactcaaaacttggtaggacgtcagcctctgcctgggatccgaatgcaacattttccttacaagatcttttgctgcaggtgaaatggatggccatggatcgcttgtaaagtctatatggcctcgtaggattgcattgaatatcccattttcggattctgtcaaaccatatgttttggtttcagtttcaaattgtgctgatataccatcaatttaagaagaattctattttgttaattaataagtagctttaagattgagtaaatgaatacaaacctgcccaaaatggaggaacaccgcatagaagaatgtataacatgacaccaatactccaaatatcaacttctggcccgtattttcttttcaagacctcaggtgcaatgtaatatgcactgccaacaatgtccttaaacatctctcctgtcaaagagggatgaattccatgttagagtatgcttcattcgaatttgaagattgtgttatcatcctaagattattccaagcaacaaatatattgataattctgtttacatatagcttaagcaatctcctagctattaatgtttaatcacacattcaatcttatagcaaaaaaactctaaataaaaatcaaagagaagttctattaaaaggtggcactgatggtatgagttcttatcaatatctactacaaaagttttaaattggtgtcacggtgtaattttgtcgtgattcttatattgtaaaaaactacggacaagtgtaatcaataaaatcacagaaattccaaaaatcttgatgttgtagacgaaactgtttcttgtacgatttcttagaatattttggatgaaatttttttggaggatttcttaagtgaagaatttatttcttgcaatttcttttttatttgagcaaatctatatgatagtgagagtttcttaaaataagacttttatcttctacaagaaactatttattaccaataaaaatatgtatttatttaactgttttttctttaatgtcattgtatttaattatttaataattcaaaaaatataaaagtgagtttttaaaaatttcttatcattttagcaaaattgtatataaatttcttacttaggacattttagaaatcacaaaaaataacttaacaaactcaagttaagattttttttattgaaaatgctcattgtagaaaactacggataagtgtaatcaatactatcacagaaatttcaaagatcttgaatcaatcaaattgcagtcacattctgttttttaaaaaaacctttacgcatggtggaatttaattataaaaaacatgacagaagagccaattattagttccatgctaagcaaaccgtttccatgaccctagaaaacaaacatgtcatgcacgttcttccacggaaactaaactaactctctttttaatcaaataaaacatgataataaataaagaaagaaagaagcaaaactagaagagtttctgggtgagaaatattgaccttgcttgtaaaaaacagagagaccgaaatcagtggccttgaggggtgcattttcatccttgttcaagagaaggaaattctcaggcttaagatctctatgaatgacccccatggaatggaaagtgtgaacaatctgcacaatggttctcaacaaggaagccgcagcacgctcagtgtaatgtccctttgcaatgatacgatcaaagagttcacccccagcacacaactccatcaccaaatgaacagattgcttgtcctcatacacattaacaagctccacaatgttaggttgccctgagagatggtgcatgatttgcacctccctcttaacatcctctatatcctccttgttaaccaattttctcttggcaatggtcttgcatgcatattgcttccctgtgctcttgtgtgtgcacaaatgtgtcacaccaaactggcctctccctagctctttccctatgctgtaagtgcttttcacgtcctccattggccttccaagcacggggccgatcgcggccggcttcgagtgcttggaaggaggatggttgggcttagatgatggtggtggggtggttatgggtgcggttgtgcctccgcctccacctccgcctccgcctccattgttgttgttggttggttggttgggttctcccttgtcgtcagtgccattggtgccacctgagcaacagttgcccatggtggaatggaagggagaacaggaacacaagggttgaaggaaggggaaggggatatgtggagagatataggtcaaggtggtgtgctttgagggctgaacaacaatgtttttgttgttgttttctggagagaaggtgttggcatgaagaaaagtgtttgttgttgggaaaggaaaaaaatgtctagaaaaaaggtatggggaaatttgaaagggtgttaaaaagggttgtgaagaatattagagggaggcattaattggaaagattgaagaaattggaaagagtctttggcgagtctcttgctttggaaggttaagagttttattaggacaagggtggagaggagttttcggagaggggaataaaaatggattttgttggtctattattacaggtcaaaggatctggaacaactcagttcaaagatttgcaagttgttactaacatcgcatactaatcttatagtttttgtttttgtagcgaaaatttgctaactctaaacgtgtctgatgagcaatagtcttgattatcttcttttcgatttgagtcaatacaactatgctacttatgatttgtatttcccttgttaacaatttttatacgtaagaagagaaatatgtcataagataaatagtatgatggaaagtgatagaaaaaaagaatgtgttgtagaaaaaataagtaagaataattcaaagtcatgtattattattagtcgctccaatattggtttaatcttattaccttcattaaaatattcataagtgatgaaactcataatgtaatatcatgttaaaaatattatatgactttgttaaaagttcttaagaagcttatttgaacttatattgttatataataacttatgttgaaaattggaagtgattagttaaattgaggaaggaaacttatgataatttgcaagttatttttaataaataagattatttcagtactgtctatttgaaaccatttcatctgtggtggtctcataccataagctcttaatgattagattatttgccgcgacgtggcttattcttttcaattctttttagtttaaaataatcggtatctaaaaataatatataatcctgacgaatttaattcaaaatcagatacttatgttctcatacatgttctctctctatttgttttggatgtcgtatcattcatcaataatactaaatcctttacccgaaatttctcataataattacaaaagctgtaatttgtgagaagcatgttgaatagggaggattacgcagtgtataaacaatcagcaaactgcgagatcaggaagtgagagaaagacaatttaaagatttggaaattacttggcaaaactcaaaaggttgagaaaaacagattttccatagatattttgtcaaatattaagcaaattcacctttgtctcttaagctaatgaaattagtctttttgttgcataatgaaattagtcttccaggtaacaaaaaatgaatgaatttgtattctattttcctcatctttatgtacaaaaagttattttttgtatactgagcaaaaatgcaaatattatattcctaataaaatcgaaggaaattaatcgattggtactttacaaagtttgattccacgttctaagcattttaacaccgctttttatatatggttcttttcttttttaactcaagctgtgttatgaacctctctatgttgaggttgtgcatttagttgcaagagaatggtacgtgacaaaaggttgaaattgaattggttttaaaaattaaaagatcaaattaaattctaaaaaaaaaatagaaaatcaaattgaacctcaaaaataaatttgagggaaaatactaatttaatcaagaaaataacatgagaaaattgaacttgtagaattataatgaatcttaatctagacttatctcttcatctctctaattggaattctctcttctctaaaactaacaaataatgttcaaaattttacgaatgaaaaaaacagctttttatcaacaaaatatttgtttatcactttgaaaatttgttcacaaaaaacagcttatatttttctattttttatctgtagaaatcaaaacaacttgcgcacttgctcaaaacaacttgtgcacttgctcaaaacaacttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaacacgataaaaccaagtagtacttgctaagaaaatcataaatcacctcacagccaagaccagcttcacaaaaactagcacttgatatgtagcctcttactcttgatccaaagtaaatacatgttcataccaagagaaatccaattcctaaaggtaaaatggacatcccacaaaatcttgctctcatgtacaaagatggaaagtggaaaagtaaaggactacatttatggcagaataatgtaaatcaatatgtggggactgatggatcaacctggacagcataggcatggattcccccagaaagattgtatactttcctaaaaccctgaaaagttcaccaatcattaaattacacaaacaataaccactttactacaacttgtgaaaaatgagaattaattcctaagttggtcaaatccacttccagatacgaaaattggtgagcaataggtatcaaaaaccatcatgagattttctttgatcaagttgaaagttgaaactgtttatccattagttgtctacagtctaaagcatctataccttgtaagcaacaaacgcatgtaacatgtctataagtcatacaattttacagtataacaataattgtctgcatggcttggaagttgcattgtgatatcaggaagtaaacaaatgatgaggcaaaacacacatacacacacttgaacttgaaggcctgacaaaaagtgggaaaaaaaaaatacctgtgactgcaaccacttggcaacttgtaatgaccgcatgccatgatgacactgcattcagaagtcaagatattgaatgcacagacacacaaaagaaaaaacattgcaaaatcagacccaaatttaataattttgtgcatagcagcaacaagttaactgagcggtctgacagactaaaatattaaatagtaaactattctgacaagaaagatgaatgaatttaaaattcaaaattattgctttgttaaatatctcaaaagaaaggcctctaaaattcaaacttggactgcaaaggcaggaacctattcaaagaattccagtttcaatattgatcaacttacaacctctaaaccaataaaggaggagcaggaggagactagcaacatgaacagatctttcagacaagaacaataaagatatatactcaatcaatttagagaacagtaatcaattagcattagtggtctagtttcctggataccctctaatagaaatgaaatcttttagaagaaaaactgcatttaccatgacatatgtatccttttgagggtcaaattttgtagttatttcaggcccccagcttccaaattgtcggaggggaagaacagtaaatcctggcaaagttgctttggccctgtgcatgttgagaatgtcatttaaatgaagaaaaaacagatcagctactaaaataaaaataagcaacctaggaagattccaaaaactgcagaacaaaagaaaaatagatgcaaataagtgtaagagctactaaatgaatatcccaaccagtcaaataaaagtagatccccttgttgcctttgagatgtcaaaagagcataaacattgaaaattgaaatgctctcaaactttcaatcgaactatatatcttattttcacttttttttaagctcattgcaaatcatatcagcttataatcactcacttggtctatttacaaacatttaaccaaatgcgatcaaacaataattcatttcaatgattttcaaaactaattatggttgaagaaaatatgagcatacacttcatcaggctctcgcacatcaattaattgtgcctcgtccaaaaagctgggatcttgaattttcacatgcagctcatcaggttgaatgtcttgaagaattgattcttccctatcaggtaaaggagcaaatttactagccataagaacacatgttggaattaacaacaacaatcaccaaacattagctcactaggtggtgttggctaattgggtcaaaacaacaccattaggctctatcaaaagccaaaaattcaataacttttcattgaaattaaacaaattaaatcatccaattcataaacataagcctggaaatacctttcagatagaacctgcagcaggtgccatccaaatttagttttgcaccttacaactttgtttaaaggtgcagtaaaggcagcctcttcaaattcaggaacctatcacattttcaccatcagacatattttcaatcaatcacataattgtactgttgaagtaaaattagagagggggggaacagcacttctagttctgtaaccagatcactacctcatctgcttcctctacagaatcataccacaaaattatcgtcagttaagtgaaatgcaagaaaaagcataatatctaatttgtcccttctctcacctacccaaagaaagttcatagtaactgtatattttcctctaacagataaagacattacacaaggcagtgatgaataccatctgaaacaggcaaaaccgccttcaaaaagttgcaaagtcaagtaaagcctaaaacaaggtttaatctaatcttaaaagcataccatttgtccctttctgacccacccaagcatccctccttcttctttggatgggcacagtgaatattccgcagcaagatcactcaaatcttcacctgcacacacacaacagattcttagaatgataaacttgaaataaataaatatcttccgaaacctaaccccacacattggcaggagaaaaagaactgaattccctcggtgtcattaacctgaagagattctctgctgaagatacaacagaagcttctggtcatcttctttgaccaacaaatgctgcaccaatatctcccttggcctatcaccttcagcagcaccactagccccagtgccatacgaagctgaaaagacagaattttttaatgaaaaattacatctttttatgaaattctttttaccatcttacaaaaaaagtgatgatacataatctaatgctatcagaaacaaaattcccaagaagcattaaggggtttgcagagcaccactagccccagtgccatatgaagctggaaaaaaacatttttttaatgaaaaattgcatctttttatgaaaaattttgtttgccatcttacaataaagtgatgatacataatataatgcaatcagaaacaaaattcagaaacagaagcattaagggggtttgcacagaatgaggacctgttgctttgggaggcatgaagaccacaaagggtgaaagagggagtgaaagtgggtggaaacggaaggttcttgggaaagaggtgagagtgtgagtgttgtgagagagagaaagggagaataagaagattgagggatggaagcaaggttttggagttgccactcccactcttaactgacaaactgatctcaacattgaccttgctgctattgctatttgctatttgtctggcggaaacaatacacacattggtttcacatattcattatataaacacctcaagagtctaattatatggagagaaaaaattcacaaatgttaattattaatttattaatttttttatataagaatggattaaaaacatttttctcctttcttgaacccaattaacattatattttcacgtcaaatgctatggacatgtaaatagtcaaatgcttaatttgatatttttctctattttttatcactttgtattattaattatattaattattaatggattgtttaagttatgtttaataagatattttaattattttttaatttatttcactagctaaaaaatttgtttgaatgtttttggtaaacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggttattcctcaaaaaaaaaaaaaaattctactagtactacttagaattttggcaaaagaaaaaaaagatcacaaacttggcagtgctttttaccaatttgtatatactcaatcacttatttacttagtggtcaacaacatgttgcatccaaatggtccaatatcatttcctaagtcaacaaaatgacttttattctgtatttacttttttccttagctgacacaaaaattgaacttgggacctgttctatctatagtctagtctctttcttacttgagcttagctcataaaaatgcttaccaacaactattgcaacttacaagaacaacctattcctttctccttcttatagccatctcctaaaagtgaacctgaattagttccttgtggtgttgtactatctgcaatgacatgtcaactcattccagcctctctaggtgaaagttgagaaggaagcacccgaggaaccatttgaaggggtccaagcataaatgagtaagcccaaaatgaggataatggcccctgccataaagcctgttggaagagaggaggcaacaccaaggtatggcaatggcatggtgaacacgtagatggatattgggactgccacaaagccaaattgcattagttgggtatgtctcataatttttcaaaattgagtgactaaaataaataaatttaaatttaagggaccaaaaccaactgtgacctaaatttaaggaaccaaaaatatatttaagcatatttcatcataacttccctcccttgttttcacaaattttagagctaagatgtccatataaacgagaaattattatacggttccaaactagaacgtttccatggttctgatcaatcttcacgtaatatgtacccgaattttattaactttctagaatatgaccactaacatgtgttggtcgagtaacatacagtaatttcaccaatataaacttcaatatagttatgcttggtgaaaaaattagcatacctgaaaatgtggaagcaagacaagatacaacagctgaagagatcttgaggagatgaagcaatgcaatattgaaacctatgtttacaataataaacagcagaggaagcagaggggcaccatcacatcctggaacaataaatcagtttctgtcatttcaattaccattagaataagaatagaaaatgagaattttaagtcaactcatcaaacagataattgcaattcttctagaaattttacatgcaggtaatcttgccttgtgacatgactatgtaagagacagatgatctaggtaatcttgccagtatggtaacgtgcttaaaattggaagtgaaatatttaggaatgacttttcatacaattttttcatagctcattcctgaaattttcactctcatttttaagtggacaccaaccttaccactataagatatgacaatatgaaaaggaaatatagcttaccacttgataatgtaccaacatttaggaagcaggctgcaccatctttaaggtagtttggtagttgactgaagggaatgccccataattttgacaagaaggggagaagaaggcacacgaatagggcctacattaagcatatattcttgcatttagacctttatttgcatttatatagtaaacacttcattgtaatccaaaagatgaacatttcattgaagattgcaggctacctacttggaaagcagatccgtacgaattgacaacaaaaaggtccatacaacagcctccctatttcagataatattgaatattgattagtatattcatgtcaggaaaagaaatgtcaggtttaaataggactagtttagcaacatgcagctgaaaattgtggtttggaagctttagagtctcgcacaatagaataatgcaaagtttaggttgggtattaaaatgagtccatcatgtatcactaaagtgaaagttttacatatactacaatttagtaatgttgttctctgcattatagtttgaggcgcatgtgcttgtgagtgccaaagtagtgttattgcataattcaggttgtcaaatggcccaataagatcattcaaagccataattagcataaacatgaattaaaacaattcactattgtgcgaaccttcaattttcgggatgaatccaaaaagattatttcctgcaaagtatgaaaaggacagtgtaaactatagagaaatagtttgaaggttgggaaaatgcaacaaacattataaaccatgataaccttcagcacggtatcagccgcttggaggaaaaatgaaactatcattaaaagactccaaaacataccaccttcctttaatgaattcccagcaccagctccactacaatagtaaacaaatgtataaataagaaggccatagaaagtaaccacaattttcatatagcttgtaccagacacatactttattcaacatgccttgggagaaaattctgtcagtccaagaattttgatgttgttgtgcagcatggaagatgtaattaacatttgaaagcattatgttagatttcaataacaaagtagttttttaccaacaagcaacaatttcttagacttctgagtttatagaacaaacctaatagtatcattaaatcaatttgtttggcaaccttaataataattgtgtcaagatgcttagactttcagagttagtttgttgacaacattgtttgtagaccatgttcattacttgtatcatggtatcatggttcaacaatgctccctttttgacactcataacctgagtcaccatggtctaagatccttaataaaattagatgtactactgaccttgctatagtaacaactacaccaatggttacaagaaagcatccaagtaattggttgactttatatcttctcccaagaaaaataattgacaggagtatttgccacactagaaaagtctgcaagaggatagctcaaattaattatctagctttattttacattttactaaacacctgcacaagttgtaaatatatgagctaaacacagattgtcatcctatagaacaatcaccagatgcaacagtaacaggaattaagaatatatgccagagagcaattgactgctgattggttttacctgagataaaattggaatcgatgctccagagagaattgctgatacaagaaagagcacaatagatgatcaaattcagaatgtgatcaatttcgtggagaaataaaattatacaactaaaagataatatatattcttagcatctccagctatagcagtccaagtatttatgctgtacattgtgaacactggaagtataagcattgtagagactgtaacaatttattacaaataatgggatattaaataagagcattttagtcaacatatagcaatattttacatctatgaaatattctttaatcagttgcacagttgcagtctgagtatacacattccactctaaatctaatgaacactagggaggcctttctgccaactatattctatgaagcaaactaacaccaataaatttccattaatggcctaatatagtctatatagtatgaatatcagtgcatcatcacaaaacaaaacaaacttgatgtactgatggaagaaattagaatgagttgaaaatgtgattcaaagggtgcaaagttacctcctgcggccattccagtggcagcagcaagagcctccaatagaccaacaactataaatggagcctttggagcatctaacatctcatccgtaacaatgcccgcatggtgtcgaatatacaaaatcgcaaagtacactattacatatctgaaatcaaataagcaacatcaatcaattttgtgcttaattgtttggttatgcatgtttcaaaatcaattctctttcttgctgcctactttttgatattgagattaatttatatatacatttatattaagttgtgtaacagttcaaaattaattctgtcaaaattaatttttttaaacattaaaataaatggcctcacaatcacccaaaccaacatttgaccacaaaatcggaaaaaaaactcaaataatacattttaaataaataattaccaatttggggatgtttgcaaactatttactaatatgggacagtcaaacacgcctaaattaggcgtgacacctcctgaatcacgctcaaattggacgtgtctccccattgcgacacgtgtccgttgcaacacgtgtcatgcattcatgcatcggtggtgatattatacgtataaacttcaaatggtcataacttttgatagaaatgtctgatggaagcgtatgatatgtcaaaacgctcgaaattcagagaggaagtcctaagcaaagttccaaaggggatttggtcgaatattttttccaaaaaatgtctctaagtacatcaaaattaggatttaattttgaatcatacaaaaaattaattgttttctacttttttatttagttttaattttatgaagcattacttttcatgaaaataacttatgtttggatgcatcatacatatcgcaacggacacgtattacaatggggggagacccgcccaatttgggcgtgacttaggaggtgtcacgcccacattaggcgtgacccgtcacgcttaatttagacctgtttgactgacttatattgataattagtttaaaaacaatttcaaattgataattttttaataaaaaatattatttgattttttttcccccacaaaatcaccttaaaaaaaaggaaacaattcttggacacggaatgcccaaaagttatcacaaaaccatgtgatgattttaacgggtctaggtccacaagcataaggacaacccggcaaatttagcataaaaaataacaaaatgcacatttcaattattcaatataaattttaagttcctaaaaaaatacatttttagtttaagagatatacatttattataaaattaataaatttatcatatatatatatataataatttattattagattataataaaaaacacatttatacttatattgcatatattatttttccatacattttttatttttaacaatttaatacatgtcagatgtggtaattatttttaagtaaaataatattttgaactgaattgtaaccgtatactataaaaattatcctatattatacttttaaattacctataataaaagtaaatatatactataattatattatatgacagttgtccggatctaaataagagtacttaatttattgcaagtccatggcataatctttattctaacgaataaaaaataaaaagacagttagaaccttaacgtaattcagttaaattctactatctttgtcttttgtatttacccgaaagtggcaagttgagcaagaaagaaagggtactgcttcaacggaaccaaagccaacttatacagaacccggttcccaacacccagcaccaccgttgcaaccgccgccgccgccacttcaaccacccggttcctacttccgacaactgcatcgcttccgccatcttccgccaccctccgatcctccacggcgtaggagcaggggcccaccttctcctccctccctccgacgtcggatgtcacccacgcgccgccgcccacggtggtccccaccgcaaccaaccgcattggccgccggacggaataaccgtatcgaaccgcgcaaatcccggcgggccgatggaactgaaagtgaccggctggtgcggcggcggataaccgccggcataatgaagccatggtttgaatgaatttatttgtggaaaaacaattcacaaatcgatataatataattcagagatcacaaacacgaaactaagttttgagtcggagaaattgaggaatcaatagaagaacatcatttgttactaaggaatttgaagtttgtaatgtctgcgacaacactaccttgcctatgatttaattattgctacatcgcatcaatgtttctttatcttataatatcaaccacaaatactattttaatctacctatttctatattatatattcataaatattttcctttttcaaaaagatgtttccatttctgccaaaagtcgtagggtcttcttagatataaatataagtaaaaagtatctttgagaatttttttattgaaaatataatattttttctgtaaaaaaattcttaaaaacatttataatcttgtatccaaataaattcataattaacttcaacacttatctagtggaggagaaagtgcaaagatctttgcaatcatacctttcattttttaaaactgtttcgtgagtatttgtgttcttgagaattttatattcaaaatttgacagtggtattaataccatattctttttggtaatggtttgttttgttgttttcagttgccacacgggcaattatttattgttatgcaccgtttgattgtgtgttcaaagattatgccgatgaaaagggattccaatttcaaattgacttcttcactggtggaaatgcaatgaactctactcaaagaaagatcgtcttgttgaatgataccaaagggatggttatcgtcaactgccacgttgcaaacagttactatcatatctcttaattatgcattccttctttcttatcattattaatatactatagaaaagagagttattccatgttttttatatctggaaaattaggttatttttatattagtatctaaaaattcattttttttatcaaataatgatctggaaaaaaaatttaatttagtatttattgttaatctcattctattaaataataatgtgataaatgaaatatcatgtcataaaatttaattactaacacgttattaaagatgatggtatggtaataatgtatcaattattaaatttgataatatgatactacgtgttatcatttatcgagataagactgatcataagtattaagttcaaacataaaaaaattcaattagttgtttgaaaaaaaaattaagtaataatattaaaatgatctatttttttaatatgaaaaactgatttaaatcctacttttattttaaaacatatcgcaccgcgtgcgcaggaaaattctccgatgaagggagatcttttgtgcatcagaaaaagctttctgtgcactttttcagaaaaaaagaaaaaagctttctgtgaagggattttttctaacaaataaaggaataccgatacgagatactttacttaagaaaaaatatttatattttgacaaactatatttatattgtagtaattaatttatcattttttcacacatcaaagagagattaaaaatgtgaaataaaagaattaacgtgaccaaaaaagatatgaaaaatataaaaagtattaaataatataaagtttatattttattcaccaaaacataaagaaagcttttgacgatacatctccagggaaggatttacatgtaataataagaaaactacatttaagtatttaacaattgtcaacatttatagattccatgataataaataaatcatatgaattgtacattagatgtaattcaaaattttaaaacattaaattttttgagttcttctcacttacgtgttattcaatatattcattttaaaattttagatagagtttaattacgagacaagtaaattaagttgtcaatttccctattaaggcatctaagtttcatgttagcaatcatgtctttaagcatatttccaattgtatctttgatgttattttgaatgaaatgcaataagtatatttctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctttttttgtcgttacatttttacctttattttcatggaaataatgcacaatacatacagacagtctcttgcttgtaacatgtgaagaccagtaacatatattggaagcaagtcaaacagaacaacaatcacaattcacacaagataaagggaatttattgtgtaaaaagaaaaagaatgaccttaagtaaggattacaatcatttaagttctaacaggaaatctaacaacaacaatcacaatactttttcagatcaaatactgaactactagttctatgggaatgggcttagatggttaggaaaaagaaatgggctagcattagcataatgttacctgtcgatgaccatcccaaacactataactaaaagcgaattacaagggatgtcacaagtagagcaggtgcaacaagtcataatgtaaatgtttggttcaacttgttttaatattatgttatattgtgtaataacttttcaaaaaggaattatttcctcaaaattaagttaaactaacttgcaagttgcaatacgaagacaaaaaagacataaattactaaatccatagatcagattatcagaaacgttgttgctgattataatgacataggtctcttgcatcacaatcacttttctttggaccgtttcagaatcaccaacgcgaaaagaaataaagtcacgaaccttcatacttcacagttcacacttgacacataaaaggaaggttaaaacagacaaagataaatttaagaaaatatacaataagcttatgtggctcacacgcatcaattggacaagagaaccgggccgagcagtttaaaaaccccccttcactaagcaatgaaggggcacatggaatttaaggtttacccttccccctcttgaacaagagaacatccatgacacgttgacaacctcaagctgcaacactatacatcaattataatctcagtcattttctggttcaatccaaatctttgggctggtaggagaatacaatatataacatgatacaaaaaatgttttgcccctcaagccttgtaatgaaaaatacaacccaaaacacttgaatctattgcaagaaatttactagcacaaaagtggacaacccagcaatttaagttgaagaaatggaagtctgcataacaaaggcagatgaaaaagaagtgacctctgcaagctgaagaagacaaggaagcacacataaaattcacttgccaatccttcacttaaaaacaagatggcagcgcaggcccgtgacaaacaaaagccaatacaacataaactatcacaagtaggacaactataagtgcaatcctgcaacatgcaaccatttagtcagtaagaccaaaaaaaagagcataactatagctaaagattgattaatagtattatgaagttgtatgaaggaaacaagtttgttgcctactattttgaaataattctaaaaataaaactagtagagataattcaaattttacttaattgaactctcaccacacatgcttacatttattaatactaatgacatgtgtacaattgcttttgataaaattaattttgaaccattgagcatgattagaatatgtccaaatttatgaccatagagttattttgggacacgtgtttttttgttagaaagtgcaggacatgattttccaacaccaaagcagaggctagatctaagtttgaaactgtctcatttatttctccattactcaggtatgggtgtgttccagttcactggatcagtttctatacattgaagttgaagggtttggtaataagaaggaaaataaaaatgttgtggcaatgcactgtttatgggaatttgtggtttggtaagaatgcccacatcttcaagggtgttcctcacctcaacaagactgcacaactctcctacattgactagtttttaggagcattcattttttctctgttttttctcttcttttgtctttgccaaggatttcttatcccccaacctttttcacttctacctcttctactcttccattctctgatcatttttcttcttttataattataagaaaaaaattaacaatggaattatttctatcaagaaaaatgttttggcaccttgggaagtttctaccaacacttcaagttccaaaccagaacctctaccttaatccccacacatccaaccacctatgtttaagcccagctggtttccatcagaatcctatcaaatatctaaaattttactctagatgatttttaggatattgacacatattccatttatgaacatccagttgataatgcaagaaataatataaaaaggatggagaaaaggtttcagattcattctagagaccgcattttttttccttataagttcaactaataagactgaggtttagatcaagaacatacgtaagcttgacatttctccaccagacagtgcttctgaaacgacgagcttgtttcctgaagcgaaatgtgtttccttgcatattagcagttttatccaccagcaattccaaccgatcacctctatctaaaactttgtcaatattttctatcatgacattccgtacctgttaaagaacccaaaagaaaagagaacacacatgagatcagaaaaacgaagtgaatcaaataaacataaggcccaattcggataaacttcttaacaaacacttatgaaagaagaaaataaagaggtaaaataaatcaagcttctctcacaagtcacaagttaaaatgaacttatagtctgatacagcttaacttttaaaagctctcttataataacttctctaaaagctaaagtgcatgactagattttaacttacaggagaagtttgatttatattatttctctatttcttctagtataagtgtttatatagaagcctatccaaacaagacctaagtataaaatgtaaaattcaaagtgtatatcaaatagaaatgcttctcattagtcattattagatgtatttgtcccgttaatcacaaatttaatgtctgtattacatttctaaggaacaattatcttgttcattggacttacgcagtgtttgaatagctgaaaaaggaagaaaagaactgaagttgaattaaatgcaattctactagttattaacttattaattcttaccatagctaggaatctaggattgttcaaccacacactcaccagcacaattagttctcaattttcaattactgcataaaatcgaagagagagagaaaaaaaacgatacgatacctgagacatttcacctttgagacgattgatcctatcagcgttaggatcactggagtaatactccatttgctgactcaaaaccctagagaactcctcgttcattccgtaaggctgagcggagtgaacggcgcgtccgtaagtccgcacgaacttctgatgtatgtcctcgagaaacgcaaaaggaattctccctacagaaaaaaaaaaaacaaattcaaaatgttaaaaacgaataaattagggatttaggtttagaattgaacggatcgggaaaacgcactgccggcggtatcgtcggccatgcagagaacggtgagtccatcggtgcgtttgacgtggaagatgtagcgatcctgagagtaagaaacgtgcatgtcgttgttgccggggattttctcgagaatttgacgcgcgattgcgctggcgttggtggtggtgccgctgaactccgccagcaccaccgatccgcgacctaccagcgcgtatagaatccccattcggtttcggatcggagattaattgaaggaaggaacgatccacttcgacacacacaaaacccttttcttcttcttctttctcttgtgttcatccactgtcactttcttattgactttttcctctttcaaccactcgctaccttctgctttatgattggaatttaattattgactttggattttaccgcctttctaaaaaccaaaaaatgttcccccgcaattacaatttactattcaaaattgttaatttaacgttatgacaattataaagagttatcccatttactttttattacaagttcagtgtgtgttttgtaatttcttgtgtggattcaccgattcacatctggtttatatagtaggccaaagtcaccaaactgatctactttttttatattgcctttaatttacttccttttttttttatcaatattacaatgacataaaataccattcaatacatagataaattgatactggatcgttctattttaaataatattagtctcgagtttaaatcattaatataattaatttttaattcataattatatctttaacacagtgattgattgatagaggtattaattcttattcgtattcaaatataattaattttaattttttatataaatagtgattgtcatgcacaatttaagctaacaagttaaatatatatttaaaagttaatatgtatttttaaaacggaaatgttaacttttttgttaatttaattatggaaacaactgttacttttatttattttcttaacatactcccacttgatccctcccccaaacccctcacactatatgataagagtatccaaagacccctcccttcgtccttgtactccccatcgccctcttctccatcatcactcttctatctgtgtaatgtgtagtggtattagaaattgatgtatccaattaaagtattctctcttctgttgtgttctcatcaatatcacaccactcatctccacctacaacctagagtctagagaacatccctctaaatttctcatcttcagagcattgttacaacttacaatgttcactgatcaaaacaatatattcaatgtgatcataccttgcaaagggaaacaagatccttatcttattttttcctatgctgcatttgctgtcatgtaccgccagttttcaggactaagtcgtttgctcccatattcttttcgtggattaataacacttatgtttttggtttgtcattttgggtgggattttcattttttgtgtcatcaaatttggttatattttgcaatctcaatgaagttcctcctcccatgccatccaagaagtgaggatcttgtaccccaggaccaacaacaagatcaagacagagaatgcggtaatgctccaaacaaactgatgtaggcagtggtggatccacattaatgtgttggttgtaatttatttccttatttttttttaaattacatataaatatattgagtgtgtaggttgtaaccctccacttttgtgtatttgatcctctgttcataatttttttacctattttataatatatattaattattaatttttttaaaataaattgcccctaactaagatcctagatctaccactagatgtaagcattaaggatgttttataaagttatttggagcattgcatttcatggtctgtttatttaagcactatgactgttagtgaaaatttaccctttgcttatacttggtggaacttttttttcgaaataattattaatgataattttagaattggtattctgtatttgtttctgaattttagtggaacctaattaatcttagtagtatttcttcccccttttgctgaaaaaaaaataaagatggtaaagagataattgttttcattctaagggctccagaatgataaagcttgataattccaacgattaaaattaaaatctccaaacaactcattttgtgaatatttataaatacaattttgataacatttttttcacacaataattctacatctcatcattttacacttattgttctcttaattttttttgtgtgtttccttccgttttcacatagatgaatccttattaatagaaatattaatcttttttttttcttgcaaaaatttgtaatgttcgaaacttcgaataatgtctttaaatttttcagtaacttaaacatggagaccaactagattccggagcaatacggtgtgaagacttttcattcggggccaaaaaagtgaaaaatcaacaatcacaaatgaaacttggtggtggattcaaatcactttagagtaactttaatggaggatttaaggggagatctttgattgaagatctttctttttttaaatccatcattaaagagagaatgcagattttcacatggagatttggttctttctcaataacttttaagatctgcacggagttcaaaaaaataattttttatgtgattgatgaaaaaaaattaaaagttaaaattaattacttaaaattaattatatattttattaatattcatatattttttcatgctttattaatttatattaattacttaattaatttaattaaatttaaaatatttaaaaatgagatacatgtgagacccattaaaattatctaagatcttaatttgggatctacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaataatttacatattttaaaatttaaacgtattactctcttatctccaaatatgttatggttatttaattactggaaatactaagaagtagctagacaaatatgatacttgtatgaaagtttaaatttagtaggtactataggttttaagtttgtttatgtcaataaagagagaaaaaaaatcaactttataaatttattgggcttaagtagaaatattaacccctcttcccccaagaaaactaaaactcaaatatagttgagtttggatccagtggattcaaaattataggagtaagagacaaaatataaaaacttataaggcttgcttgtgaattttggtgaagtgcgaggcacgaaagctacttctcaaataatcatattcccactctttcttcagtatctactagctttaaatccctcatcaatctgtctaatgctatatcttccattcatcaacagattctggagcaaaaaacactgtgattcctattcataaaatgaatatgattgaatcttgctatggcccttaattgaagtacgtacatgtctgtggcatttttacctaagggcatctttcacaacatgacattttgtatcaaaaaatccatgcatgaatgcagaatatgaatacaataccatgcggacataaggataatataaatagtacttcgtaggacacgatatggatacagctatagcacatcataaaaaaattgtataaaattagcataaaaatataaagaactcatgttttaaaagacactgtgatgggttattgtgaacatttattagacgttgtaatttatttattctgatgtgtatgttgtaatttatttagttaccatggtattcttcccatctatattttgaaatgttcctgattaattaaaatttatttgtatatatatatatatatnnnnnnnnnnaatactacatagcatttcataatgtgaagatcaaacttaaataagaatgtttcttttgttttgtgagtaatgattttgataagggtaggaccaggggaggaagaaacaaaaatatctaccatcttctcttcggtttacgtgaaaacgatatatagcttctttcataaatacacaaatatataagactaccatgatggttccaagtaatcatggtgacaagcagctgaaagtatccaatgaatgctaaaatagcaaaccataatgaatctgtgaatcatcaagtttatttggcagatagtcattgcaatatgcaagtatacaacaatgtagtaccaaagaaggactacgtgaccttttgacttttcagaactagtaattcataattgaaattaacaatattgttcttctcctcatccttgcgatttttcagactgaacgttgctgcctcaaccacccttgtgagaaagatttctttcaatatgggtcacatgtggcgtgagttttaagtggcattattgtttattggacaatggccgtctaaggaatcaaagtttttggatataatctgtttagataacatcagaaaaacatgatgaccatgtcttcttaaaacactttttttagtaatcctcttaaaaataattaattttcttggtataaagtgataaaattattaaaaagaataatcacgtcatatagaattatgaattgcaggcctgtttatgcttgttttgcacttaaaacgcgtattggatctttctatgtttatttcctttctaataatgtttttatgctaaagtatggggaccattcatttcgagtggggacatgatcagtggcggagcataagattggtgggggtggcaattctttcccccctcaaaaataaaattttaagttttgtcatcactatttatggtaattccaaaaacaaacatgccatttagaaaaaagttttacatttctcagtaatcatgataatccaaaaacttaagtcattacaatttataattaatattaaaatggaaactctgagaggagaaagagcaagttaattagaggaaaccaatttgcatggctaggtacttgacaacgtacacaattaatgaggactcgattggtattaggtatatttatacttaattaatactaagtcaggaaataaaaaaatgataatcaatctgaaaattggataagaaagatagaaatcaacaagtttttgaaaagaattttaaaataaaatacaaatttgatttaaggacaaaagtgtccagggaatgacaggcacatatatctctttcagttgggcaaaggcaaaactattactgtgcttcttgtatgcacaaggtatcaagttctagcaccaatcaataatatttctgaaaagatatttagtttagatagcatttcttccatttcaaaataactaatgtttaagtctttgaaaaaaattcaaattgattgatgttattattttttaatgaaatatgtaaatatctatttctgtcatgtaataaataatgttattttagaagatccaataaaatatttattgaaattaagagaaaaaataatgatattttaataaaattatctcctaataaatattaattttcttgaaacacttattttattggtttgtgtaaaaaaatattaaacattagtcattttaaaatagaaggagtataatataatagaaagagatagaaaaaaataaatgttaatgggatatttataaataactcctcttatatttttttaaagatgttttataaggctattcctctagtattgttctatccttgggtacaaaaagtactagtggggtgtgtaccacctgacagatccctctatgtgtgtatttttaacatatgttccttctcatgttaacttttttttttttttctttctttttgctctgtttagccattttagcctctccctaatttatgccatggttttgacattgcgcgttcctacccactttgactcgtagcccgatgctaagttggggcaaacaattcagtcagcataattttttttggttaattaagtttataattcttaactttttcatattataatttatgatctcttaaaatattttaataatttttagtcattcggttaatttttcatcataacttttagtttctctctttttttttttcatttttaatttctaatgtttttattgctcaagagtaatttcaaatataaaataaataaaagactaaaaattgacaataaaaattaattatgaacaataaaaataaacaaaagattaaaaatatgcaaaaaaattaaaaatactaaaattactaacacaaaataaataaaggattaaaagttatataaaaattctaaaggactaaaaattgaaatttataaaagttgagagactttaaaaatttaatttaactattttttattcaaaaatattaattattagaatgttaattttttgttaataaaagaagattaaactcatgatcttttcctcttttctttttccttcaatcattctacccatcttatatatcaaattcactaaacataataaatggaataaccatttgattctattttttctttagtacaagtacaagaatgtgttactaaattatgccttaagttcattgcaacattgaaatataaacttatttataatctggtttgcttgtattggcagtgaattttgagtttggaccaccgtgagacatgatggtatgagaatgtgatgggttgggtggtgacacgataaaaggtacccaaaagacaaagcctagcaagtctaacctcattcattcatcgtttccttgttctaaccgaaccagacaaattgtccagagcagcaattccaccggctaccttcacaaccggtcaccccctcaacaactctgtcccatgttcttattttctaccaccgcacgaggcaatgccaagtgcgaaatgagacaaacaaagaccaatgaaatgctcttatcacaattgcacactctttattatttttagtattataataactataaacactatattatatatatgtatgtatatgcgatgggtttgttgcagtgtaagctaagcttcaatgaccattttaactttgacatctactttcataatgaaaagaccagaaaaatacaaaataaagaatggtagatggctctaatacaaagccataaccatgactatgtgctgtttctgtttcatcccttttttcctttttctaaaaaacaatgtgttactggcatgttgattaaaaaaagaaggaaaaaagagtatccacttggactgttcaaaattatttctataaataagtagttgaaataagataataaattgttcatcatcctctgggcattctcacacttttcgagtgtgaattaataaccccctttgatttttgaaatactaaatcaattttggtactattaatatttttttttctttaaaaaaaatagagacatcacgtgcaaacattttatctttgctttgaacagatttctttttgtattttaactttaatgtgactctaaaatttaaattgcttgatgctgttaatcatgatactacagtatatttgaacctcatacattaattagtgccttaatttgtttagttgcacaaataatacttattttgaacttcctaattttacaacaaaagaattactccttttataagttagaatcaaaacatccctttgttgcattaattgatcataaacaagaacatatattgcattacccaagttcaaatccatttcatcataaaccagattttctccttttaaacaaaactaataaaaaaatagaaaagcatgcgatacagcatgttctaggtgtctcatcatagagctttgcggctcatgtgcagaacagaagaggcaatcacggaataacaggaagttgtttcctacattatcttaaactatttttccactgcaactcttcggattcgtaaaattaaaatcatttttgtcctaatcaatgaaattgacactaattttaaactcaaaactaaaataatttaaccaaattattagatacaaagtgtttaatacacctaagttaaagttaatttaatgaaaaaattattaatcaacctttatttatctttcagtcaagttttagaataataatttttaaaaaaatattataaaagttgataaacttattatataattgttagtttgagcagaatagagaatttgaatttcttaaacaatatagattgagctttacgtatgaaaataaataaaattattagaagagaatatctcagtatatattcttcagtttttgttgaataaaaagtgacaaaatggagaaatactccctcaatatcacgatgtaggacaccaatgaaatcgtgcagccttaaacagtaattttacgcaaactcggttttcatttgattccttgattcataggggtactaaatgatctgtggaaagaggttactcatcaaacaagattttttagtaagatcagaatttcacctaaaaaaatgattgtctatacctagattgcataaattatttattcaaactaaaaatgtaaactatttttttttttctaaaactttatttgatgtgatcgatatctgaagattttaaatttttataaggtagtacataaaaaatttaaggaggtgaatgaatttgaattagaatcatcaccatcccaaaccaaaatcctaccatccatctgagaccattatttatgtgtttaggtaacattcataatttacaggcactaactctggtatgttgctgacgtggcacattttcattggacagttacctgacaagacttaaacttgactatatcggacacaatgcccttaccttccctccccctctttctctctctacccttcattctctctctacctccacactctcagaagacaccagaagtaggtgaaaagcaaagaaccctttcttctcttgagatttttcacatcaccaccacaacacaacgactgttgcttgctcctcgcacctaatctgcctcaaaaagtgcgaaaaaatcgcaaagaaagtgacggaaaattgaaaccccagaagggcaaggtcttgcccttgttgtggcttatgtgaggatacaatcaagttgggatttttgaaccctaggtgctgaaagtttgaggtttttcagtcagatctcagcgattttggtgttgtggcttttggggttggaactcactcgtggatctctctgatgggttgactcaatagggaactgtgattggttttgtggggttttcaaatgttgaaaggttaattttttttttttttttttttgtggggtgatggggttttgtttgggtttgaagtgagtggcaatgctggttcttcagtgatactgtgtttgtgtggaaatgtctgctccttcagcggcttttgagcgaccgagacctggggcttctaatacggtacgttttgttttggaggggcagatattatgttgactttttttgttgaaaaaaatcgatttcgagttaatgcacattgtaatttaggttagtttaattgaaatttagtcattagattaattttcttttgaataaaattaatattttcggtgcatgttagtttagttaaagaattttttttttgcgtttataattatgtggcaatgaacgggatttatgtgggcaatgtgattgatggttgctggcatgttggaggctgagattagtacctcagttttcatctttatttgtttactcttttgttaaatttaataaggaattttaccgtttggactttggaggatgaaaatatataccgaacagattggcaggtgagtcaagtgaaaagaaaatatattgagcaatttaacccattaagtaaaacctattaagacacccgtttactgaactacattgccaaaatgtggaaaaactaggaaaaaaatatagggtagttgacaaatttgaagaatatatactgttcttaaataattataatcttgatatctactattcctaaatatgatgctattagtatttaccaaaggatcaacttggattcggagtgggtgggggctgtcatgcattttggttacacttgtttcatttcaattaggtttagtctggagctaccctgtggttcctaacagatgttactatttggcaggtttttaaaagtggcccacttttcatatcttcaaaaggttggtgtctgaatctctgtctcccctgatcgtttatttcttgttgtttattttcatattctcttgaaaggagttttttgtttgtttattttggtagcttcttgtaacgactaaagaatcactgaaagaaaactgtttaaacttgcagaactttgagggtctgcacctcccactgcccaattggcccctatcctcttacaaaatgacaagatatccctccctcaaaacaccccttcttatttataggaaaaatgccttaaccaaactatcttaaataactaactcactaaaataactaagagaaaaaagactatgcactgataatgtaagaggatgacagttttactctgtcatccaatcacaacccaccctttatggtaagtttgttaacttttacaataaatctacctaagaagtcgtatcaacgatgatttgtaattgtatgatagtgtaaaactattttgcaccatcagtgcatgaccattaagctctataactaatagataggcaactactgacctattgtaactatctactaatggggagtacctaacatttctgttctctgtggatggtatttattatattcaaattaatcaatgatataggaatttatcaatgttatcccattttgatcttctgtaggaataggctggaagtcttggaagaagcggtggtttatactcacacgcacgtcattggtctttttcaaaaatgatcctgttagtatctctcaaatctttctcattcttgctatgatctttatttgatatctttttgtgttctgttgttctgtgtgattcaattctcaattaagcagatatggttacagatcatgattttgataacaaaaattaatatagtgattgatttagctttcttgatatatgaactaattaacattttatggatatactatgtgctgatatgttttggaaaaatggcattttatttactttacagttcttattggagagtaatacgtgactgtagactaatagagaattgaataatactataaaagtcttagctattagtgctgatttattttactctaatgtattaactatcaagttacttttgttgttattatttataattgtctttactttgattggtcatgtagagtgcccttccacagagaggtggtgaagtaaacctgacattggggggtattgacttaaacaattcagggaggtatgttggataaattgattttttgtagttgtaaattttggtgtcaatctgtctaaaagttgtgaattttattttccagtgttgtagttagagaagacaaaaagcttcttacggtattatttccagatggacgtgatgggcgagcattcacccttaaggtgatgtgtttattatatttttaagtgaatgagaattaaattcaattgtactacttctaaatgtctttttaattgttgggccatataaattctgattgttttctcaaatatcaggctgagacatcagaagacctgcttgaatggaagacagctcttgaacaagccctcgcacaggcaccaagtgctgcccttgttatgggacacaatgggatttttcggagtgacgcaagtgattctattgaagggtctttccatcaatgtatgtgctcattattccttaaatcttattcattttatgtttactagcttatattagttataggtcaattctggtgttgctaggattctgtattttttattttaaatttcttaacattttatttataggtttttacggatttttgtcatccttctttttcaatagaaaaaatctgtcctcattttcactatattttgtgcggtgcttccagggagggacaaacgtccaattaagtctctggttgttggaagaccaattctgctggcactagaagatattgatggaggcccatctttccttgaaaaagctcttcggtttctagagaagtatggtaagttatgatcttctattatatatgtgatgcatctgcatttcatttcactttttctcctctcatgattcaaattttaggagttacttgttcagctttatttctctataggcagtttgttcaaaatttgttggctagtcggtctgtctggataagtgaaccctgtgcttaagttttccaatattttgttcaactggagatcatgttgcattgtatattttggtttttctttattggtcgtgttacgtattacgttaaaatgcaaattacctcttcaaccttgaccctttggagaatagcctgtgatttaaaatgttgtaaattaagctacttaatcgttaaatagcgacattggtgtgcaattattgaagcacattggacactaaagctcatctatcagcaaagcagatgattcctttgtttaataatttgagtgccttccatgtgatgttgatatggctttctgcaaaagcacctgactgcataatgacaaagaaaaatgttgaatgcacgacttctaccctatttttcagtgaagggcttctgctgattttactatttttaatttgcaggaactaaagttgaaggaatactgcgacagtctgcagatgtggaggaagtagataggagagttcaagaatatgaacaaggtacaaacagttatcttaaacgtcctagcactttacatgcatttgaagagagtaggttgttggtacttggtacagataacattagtgaagttaattgggcttcaagaaaaaaaaatagcaatgaagttcattggggaaacagcaaggagagaaaaaaacataggggaaaggaaatctaactttcataaatcctgatcatccaaaattacaaaaaggtgtttagagaggggtagaagagatttctaaccaagcatatctatgcaccttttcaagaactttatattgttctgaagtagttgttctttcttgccatccaatttatgttataaattatgctggctacttttagaatcagccactgtctatatggaaccgatgttatgaatatttttgtagttcaacccttctgttggtgaaagaccagtaaagataatatccagacgtagacactcagtttaatatatggatttattttttgatacatgaaacttatgaatgccttgttcttaattgatatttccaggcaagactgaatttggtcctgaggaggatgcccatgttgttggtgactgtgttaaggtatttatactagttttccatcattggttatttaatgaacataaatatttggggaaaaaaggaaactatatgttgaactctaatcatggagaagaaaatcctctatctaatatttgacatgcctacaaacactaggaagtaggaaatatggtagtatctaacctacacatcattcaacagtgggtacagagaattattgatctcaattttacgtaacgtaaagtaaggactacacaagaaatagtataagaaatcctccttaaacatagaagcaattgagcgcagaacaaaaacattaaatcaaaaactgacaatcacattaattattagtgtaaaagagctcaattgctctgcatgtctattgtctactaggtaaaaattctgaaagagactgagtgctgatctgggaagaaaggcataaaaatgagttaaattttgggaatatttctagtgccaaaccatcatgttcatgcaaccagtcttaaaaccaccgaccctacttgcatattagatatcagtcataatagctattaaagatcacactaacaagaattgctggaggaccatttataaagctgttgtatgcttctgaaagaaacattgcagcagcaattttttgttttacatatcattaccagcagtagcaaacccccttttattcaagtactcatcagtatcacctattagcttctagtctaaaagcctgtacaatctaaatgaaatctggtgtactttgtaaaatttattaatataagagcaccaggcttttttaatagtttttctgtgcttacaattaagaccttgaggccatgacctgtaatcaatcatgcattcttccatcagcatgcctgaattggagcagctattattttggtaaaatcaatctaattaatacggatcctggatttttaaaatgttttgttggattatgcattttatttaatgacaatccactgggtatatttacagcatgttctaagggagctgccctcttctccagttccagcttcatgctgcactgctttgttggaggcttatagtaagttgagctctatgtttaatttctttatgattatatgttctgaataggtggtttagttttgttcttttgaaatgctgctaattgctctatttattttgcttttttttccttctattttttttatggaatatgtttgacctttggaaaatataacaacttatcctttttcttttttttaaaaaagctgttaatgttgaaaatttgctgtgaaatattgaaatgtgtggacgagttcagctatgtttggcccaccttttttatgtggcttaaaagctactttaaatttgtgtttgatgtcagttactatcattgactgtcctatttaaatctcacctatttttttcccctcattttaactttatttgcttcttatcttggatgtgcaaatttgcttatgttgatatgtctaatgcttatgtactttccatcacaaattgtcagttgttgagttttgttgcttttatcttgttctctggatgtgaatatatgcttgagttaattgttactattttattttacaagaaattgatcgcaaggaagctaggattaatgcaatgcgctgtgctatattggagacttttccagagccaaatcgacgtttgttacagaggtgctctctctatctctctctctctctctctcttctccccgctgccttggcaatgacacacacacactattctttccatttgttgtatcttgttcttgtatttgagtttgctatggaataattatggtagaataattaaaaattgcacttgaagagaatgtatattgggttttcttgatttctgtttggtttcattttaagttagaacctttatgtttttggagttttgttcaggtttatgtggctttaagaaaaaagcctctaaaaactacaattcaatgaagttttcactatcttaccctaagatatttgtaacctatgataatatctggtgatatgatagaagattggtgtaacacccattgaggaaaagatgacaaaatcggttaaggtggtttgggcatgtacaaagaaggccacaagaagcgccaattagcagagtagattgcatgattttttagcccaagaaaaggagaagagggaaaccaaaatggacgttggaagaaatcatcaaaggagatctcagacttaataatatttctgaaactttggtttttaactgtgccgaatggcgttgtgtgatccatgtagccgacctcacctagtgagataaggctttattgttgttgataatatctggtgatgaggaataacctgttgcagttattattatgttgataagtagtaataataccttaaatttgtagcctgcttaatctgagaaatgcacttgtataatcttaaaatgacaaaaacaaatacccttaattttttcaccataatttaattgttatctctacctttgcagaattctgaagatgatgcatacaattggttctcattctcaggagaatagaatgactccatctgctgttgctgcttgcatggcacccttgctcttacggcctctgctagctggagaatgtgaactggaggatgaatttgatgccagtggtgatagttcggcccagcttcttgctgctgctaatgctgctaataatgctcaagcagttattacaactttgttagaggagtatgagaatatatttgatgtaagaaactctcaatcaatttgtattcttttgattatttgctttctggtttgtgtatgattacaattaggaaaattaacttctagttgctgcataaccttcatttatgttttgtttagcctgaggtatcctgattactcttgggctcacccttttttctgtccttgtatgggattcttttgcttgtaccgaagatgcaaacttactatgaagttttgctacgggacttgttcatcaagttaactgttgctataaatttcaatccgtagattgtataatgagctaaaaaggtttgacctcttgtagcatacattgttcctataatgcaactaaaattgaatgtcgattcatgtgactaatgatttacccatggtcagttggctgtgtttgctaaattttgcaattccaaaaatgtatgttttcattccttgattcaattctaccaccttagtttttatctgctgtttcaggaagaaaatatacagagatgttccatgtcagcagattctcaggttgaaaacagtgggagtgaagattctactgatgatgataatatagatgtgaaagaaaatggttaccatgatgcggagaatgaagttgatcaggagacagatgatgatgctgatcgtattcagagtggaaaattgagtgagagtagtggttatgctggcagtgatctttatgattacaaggttatctcctgcaatgttattttctctgttatagagatttatattgattaagctcttgccgtgagtagcaatgttattttcttttctctctatcctcttaaactcttctttgtgatcctgcaggcatttggaggtgatgattcagatgttggatcctccagtagtaaccatgctaagactgaaaatgctaatctgaatgctgtttcagataccccaccactgtctgaggatcaaaacaagcaaagaaagggcagtgaaaatccagttgatgagaatgatgcttcaaatttgttgccttcaactgaatcttatcgatccatgggtgagattttatcttctatggaccccggcaaccttttgcccatgccagtgattgaatcaggttctggaaagcaaacaagtaaagctagtagcgctagtttcagttctaagcggtcggcattctggggaaggagcaatgtgagttgttattttttgaccatttacagcctaacaactttgtaggatatctaaactcagtgtgaatatagaatgtgagttgttacaggaatcacaattacactaacaaccatttataggacaatcatacatttatgtgatactgagttactgacaatatatttgcaataagctgccattaaaatatgcagacttaatatgctagcagtggatatacttaaattatgtttgaggcaaaactgatgcagacttaatatgctagcagtggatatacttaaattatgttatgtgaggcaaaactgatattttctattgtagttttgaattttcaaggtaaatacatggcatctgataatttttttgatttaagcagccaaggaagacaccatcagtggaatccgttgattcttctggagaagaggagtaagatacttagctttgtactttttttctttgtataatgtgctcttggattgtgattcttgatagaattccaagttattcttcaatgtcttcttatagattttttggataggtggtgttaggttctctagcttggcttttttcatcagctgtaacagctatgttttgttatcttcttgcattacgtgatttgctttatacctgtcttccttttttcaaccttttttcttctttcaattttataccttgaaaacaaataactaatacttttgatgcctgtaggcttgctattcagagactagagattgcaaaaagtgatttgcaacacagaattgcaaaggaggtggatttcttatgcctacttatttttatgctgaatcatataacgaataattttttttaatggaattggtcttattttcattttaggctagaggcaatgcaattttacaagcaagcttagagagaaggaagcaagctttgcatgagcggcgcttggcacttgaacaagatgtacatattgatatatctccctccaatatgaattgtaactgtttaaatttaatttgctggtttgccctgtgctttgctgcttgtttttaatgtggcatgtgattgcattttctgcacattcttgggtttgacattcctgacatcatttttgctgttttttttctttaaattgatttcactcttaaatttaaattgattaaaatattcttgcagaaaccaaaaatggtttctaatgaattttccttgtgtattactacaacttatgcaagatgtggttgttaataatggaaccactttacattgatttatgatatggataaaatgcattctacactaatggaggtttatcaaaaaatataatttaaagtgttacttgctggaagggttttccatattggaaaaatgttttttcttttatattctgaatggcattttaaagctcttttgaatgtatacttctgctgactgaagctcaggattttataatcactagggccaaaaattgtgccatatctttcttttcgttcaatagtatgtgtcctgtttgatggttattgtttcttttgaaagtaaatatgtaaaagtcttttatccctcatattttctttattttcttttttaaattcaaatggatataaatcccctcattataattttgatcccataataagatgcaactgattttttaatctacaggtttcaagattgcaagaacagttgcaagctgagagggatcttagagctgcattggaagtaggcttgagcatgtcttcaggacagctttccagttcacgtggcatggattccaaggtgatttgatatttttgtaaattttaatattcgttttcccttttgatggctttctcagtacacattctgtaaaaaatctgctattgtacagacaaaggctgagctggaggagattgcacttgctgaagctgatgtggcccggttgaagcagaaggttgcagaactccatcatcaacttaatcagcaacgacagcatcactatggttcacttactgatgtgggtgatcgataccaacatgcccaaaatcatcctcaacagtgagtatgcagacctatgatatttgtaataataagaaagagaaggaatctacatatgaaaatttaagtattaactattacagcttttgatgtacttcaaaattcaaattggtgctagttccacatgaatttgacaccaaatccaatttaactagcaaagggtctactgacatattccaacttcaaatggataagtacccactaaagttgacacacaaaatattggagttagagaaattttcctaaaaaaaggagatgaaatgttgtaatatttccaattttctctttttccttgtatccataataaagggtggtttgtatgactgtatcctctgcatgtgtgtttgtactcattctatggtaatcattttaaagttttaacaataatttactttttccagactcaaacactagtttgttgctgcatttctttaaagtttatgggaccagtttttaattgaaagccatgtgaacttgttaactcctttagtagttatttaagtctttttgacttgtgcaggaggtttcttcagcaagattttgattcaacccttgcctttgttaatcacgagaggaaacaaaggactgaggtatgtcttatagtctatttctcaaaatcaaaactaaaaggaaaaacaatcaggaagatggttgaatcttccctatgttagtccaatcctttcaactccttctgttagtattaaataattacatgagttgatacattattacacacaagttagttccataattaacctctaatcgagaaacatgtcaagttcttttctttgcttttattgtaaaacttattctcatcatgaccatgaaaaatgatatagaatggtggcacaaatcaggaatttttattactggattcatttctttagggtattagaatctaaaatgcttctgatccaaaattgtcactggttgcagcacgttcctctctaatttagggatctatcattttttatttgtttttttttatgataaaattagttcattaattatagatgatatcttcttttatggtttggactttggagcctcttcaacaaggtcggtaaaatttgccttttcatatatgcaggagagtttgttgggcactgattggagaaatatcaaaggacaagtattggcatctggtaatggtactagacagccttctcgaaagcaatttttagagtcaagtcctagcgattccaaaagtactgaggcatcaacaagcatgtctgtcgatgatctcggtgccgttgattcggcttctgtgccctccacctcaagagcagcagaggtaagaattaagttaaagaaatgtttcttggaattatgcataattctagtaacatctttttttcattgtcagatgagtatcataattactttgctaatacatttttgcagcatctttatctgcttccaaataattcggaactaacctagttgcaatggtttcaggtgggggaatatgcaagacatccatctgtagcatcttcaacattagtagagttaactactcgtcttgactttttcaaggaacgacggtcccagttgatggaacagctccataaccttgatttgaattatggttctacaacttcccaagactttgtctataaaccatcttcgccgtcgtggagttgactggccaaataataggtgcttcataaaatccgtggggaagaattttggctgacatgttgtatatcctttgagtctgacttattgcatatatttttatccttcatgggtctgtgtactgcttcattctcttggttcctatttaatttcttcttttggtagtgaagttcattgaagttgaaatgaaaggctttccttttggtcttcaggtttctctttttttaataacattgagttcttttgtttttttaggggagggggtggaatttggtgtaattatatggcatgtcaatagatggggaattttgttgaacaaacagctaaagtgaagaaatattaattaccgttttggcaaattctttgtacatagggacatgcaattgccagtttatgtcacctatgtggaatgattggtatgtatgttattgttatgtatctagctggttgtttgtgatgctattaaattatttctttagtataacgctcagctttttactcctgcgtattctgactttcctaaaatcatctcaaaagcatggaaaacttagcatgttaggtggaaacgagtcttgttcgttttattttattgaattcgtttttaagatgggcatggctaacaatttgtatttattgggagatataaagttgatttagtgggagaagagaagagggagatgttgtaggtttgaatttttcttgctaacaaaaaataaaaaattaacaattaatactggcctttaaaaaaatattaatatttacccttaagtatttgtaaaaaggttgctcttttgtcgttgaaaccaatgcagcaattaatattaaaatagaacagtacaatttggtctagttcagttatttatttcacacatgtatagatttttttaaatttttttgatatgaatcactttatgatatttctttacattatgttattattgagataaaaaaatgctatattattgacagattattgactttggtatcagttaccttagagttaacaccggtgatttataattaaataataatataaaactattttatattattactattagtgcataattattaaaatttactattattattattaagtgtattcaaatgttcaatagattaatcctgatgtatttcttgttttaacaatatataactatagtattcaaccaataagaaaatacttttaacattaaatatttcttcaaaattaatgatacatagacacttttattacaaacatacatttaacatctcaacatctctttctttttattacattatatctcttattatatttatcacatttctctttaatttctttgtctctagtgttaatgaacacatcagtgttcacaaaactttaaactttttcaacgataaataaattggtttagaggtaatgctaagaataatttatatgaccaaaagagtattctgaaaccactcaagatcaccatttgtatagacttgaagaattgaccataatagagagagacaaataaaatgttgtataaatatgagttgttatatgaataacacaactcagcctaaaaagaaaacatacgcaattccaaagaaacaatagaagacatgggagtaaatgtaaaatatttagagtaaattacactgcagagttctaactatattgctgcaatgacatcaagtaatgtaaccattatactccttttacgggtttgaacaaaagccaccatgatacttggtggggacaactcccaaaggtgtctgattggaatagtcgcgtagatggaactaaccactccccatttccaccaagcattagaatcattaggagccaaacaagtaaagtgaaaactgaaacctttttcctttgcaaatttctttccactaaatgactaccatgataaaatgataaccattttctaccatcaaaaagcgaactcaaatcagttagatatccatacgagtattttctttacattgacttacaaatgcagtcgctactagttacattatgttttcatatattcttgtgttacacaggcattcgcttgcctctatagcggtcaaacaactgcaaaaacacagaaaattagcaagctcagttggacaatttcatttacacagaagaagtatcactctacaatctctagacagatatatagaaccaacgtttaatgtcagattcctcatcgagacccaccaggataatgttaaaaaaatgaacacaatgacgaaagttttataaaaaacatacatgcaaaaagggatcagccacctccacctcccaaaaaattcagaggactgtatggcttcatttgtagttcatcgtagcctcattgaaaaagtgaaaatgtttttaggcctaaacttaaagctcttttttctaaattcagcatcataagactttagtttgacattcactaaacactgttgcttttcctctatacccaatatctcactatcattcacatctattaatgaaaatcaatattctccaatcaatcaaagtgagtaaagatttcttgataactttcatgaacaccaattattgataaggtagcacccagactggtaaatgtgtaagatacttttgtgaagacttagatgacaggttaacgcatttccattcatcacaaatacataccgatcgaacaaatggttgttgaaataaccaaccaagaacaggaatcttctgtaagaaaacagccagcgtgggccagaaaccactgcacagtataatccacaattagctttaagcatacagacatactcaaacataacagatttctttcaaattgcaccaaacctgaatagtacgatgaatccgtaagcctcaacaatcatgcccaaaataggccatcccatgatgagaataaagaacccgacaccaaatgagattgttccctttaagaagagtaaaagtgagcagggaaaatttaccatgaagacagcatgatgcaccaagtgaaaagacatgtacaagtttaccttgaaattacttcgtttcatgaagaattggatagtggattttagcccaatggttatggacactccagaaacaaacaggatctaatcatgcagataacaaggtataaaaaaagatgtattaagtaaaattaaatgagaagcaacttctataacaagtaactcgtggacaaatcttacatttcccatggctagcaatcccttgtcaaagaagaagataattccaaggaatgaaaaaaatataccaaagccagttaatcctaatccaatctctgtatcatgtgccaatcaaatacattaaacatagcaataacaaaattgtagtagatataaaaaacgtaacgtagaaaaatagtacagtttagtcaaatcaatccttatgccagcaagtatgataccacaacataaagacactaatatatttcatgaaaaatctataatgttattactaggcaaactaataacatacatcttaaagatgtctttcccccaagaacctgaagaaaatcagcttgatggattggaataccattacttacaatgtgataagcaatgccattattggcggatttcaattagcatcattaggtgatgtcattacttttaaataaccaattttaagaaaaaaaatattcctataaaattacaatcatattacttttgacaagagaattgggtaaaaaactacgtaccccatagcccggaggctctacgctatgcgcaggtaaggggaatggatattgtatgcagccttaccctttgcatatgcaaacagactgtttctagattcgaacccatgatcaacaagtcaccaagacataactttaccgttgtgtcagggctcgccctctgacaagagaattgggtaattaacattaaattataaaaatggctaccctgtctaatatgtttatggaattatagctaacaccccaataatttattctcactcataagcattaaagacaacagatcacttcatataatatcattttcttgatataagaacaaaaatatcatattacacttactcttccgatcattcatctcaaaggaaaccattttgcaaacaattcagatattcaagcaccttgcccttgctgaaacacaattaaataaccaaactcggtcaataaatgagtgtgaatcatattctttatggacagtttaatttataggttatattgcaacactaccaccatgggaaatcttaatcaaagaaaagatcctgggacaaccaactgcaatgttcagctcccactgaacaaagcatgtgctaaactttaatttaaccgcccataaaatatcagtttttcaatcgaaatagttctcggatataaagctgcttgtgttcagagaaaagcacaggcaacagtataagtaacaaaagtttaaaatagtagaaaagcaatttgatgttttactgttatagcaattcaagtataacttgtaatagaagggcaactacgatgatccatgaagaaggtgtgcatataatgtacaactgtcaaaccaaaaattcgagtcattctgaaagcccacatcagttagtcaacttgaacaattgataccaacaacattcttctctaatcaataaattatgcaagaatagtcttgagtttttccaaaattttggaaccccactatgtattaacaactgataaccagctttttctttaactaaattgctcattttccactcctttagcctaaaggcaaaacgcaagtcaagaaagaaatgaagaccaaacataaattttatctgcacacatttcaagtatagcattctaatgaccaaatagtcaatacctaatccagggctcaaaaattgaaggctatttcgctacaccctttactcacactcacaccttaacctaccccaataatacttacaggatcaaaacccaagccatagaaaccagaaagtctccacaaaaactaatacagtaataactactaagcactagatctattaagctattcaaaattaaactaaagcatcacatacattcaatattcactacaagtgttgcataaggtacggtcaaaatcacattaaaaaaatggaaaacagatgcaaataaataataatcataataataacaattagaaagctaaaattactaaacccaaaaagaaatttgcacatatactagtcatatagccacttttacttctacataaatattttcgagctttctcgaattttgaataatcaaatttccgtagaataacgattgagaacacggattcgcagcgcaattaacaattatcctcctcggtggctaagcattttaacaacgattgagaaagtattcaacgcctctacttcagcgacacctcttatgaaaacgaagttacgtagtgctgctactgctatgaattctggtgaagaaaatccttcgaaattgaatgtgaatttgaaccgagcgattcagagaaagagagcgttcgggatttgaaaaacgaaagcgtagtgaaagagaactgaagtgaagcgatgggatctcacatctttggtttcagtaacagaaacaaatcgatccaaaatcataaacagaaaaaaataaattaaaatgcacgttcactcgttcggggagaggtagagaggtcaccggtgtcgggagcgaggcgtcgccggaattagttggaaatggtcgccggacgtggtcgtgccgtggtggtgttgaataagaaagattctcaattctcaaatgcaaaatattttttggtcagaaaaataaaataaaaatacaaaaaattgcattgataatataaaattttataaatcgtcaaaactcggcccaatgttaatctaaccatgtacgggttttgaaagttcaaaatctcggcctaacatatgaatatcagccctccaaaattgcttttagcccatagcatgaatgcttctttcctaaccaaattatgattttgtttttgttatataaattgatacaaaatggaagtataattttattgtgtaataatttatatagcaaaattatatttttattgtactttttttcagaaaaaataatgtataatgaaaatttaattatattatataatgtagaatgaaattatatttttgttatactttcttaattaattttcacttgtataataaaatcgtgattcacctaaactagtagaagtgcgaaaaaaagagtaaaaaaaacacaattgtgagaaatgatatttttggaatttgaaaatattggtaaggaccactaacaatccctaagtgttacaccatggaggcaagagtgtctcaatttagtcttgagactaaaaacgtgaagagacttttaataacaacttttactacttaacagttttcttctattttatttatactaaaatgaaactttaaaaatatatatatacaaaacttatattattatcataataagactagcaaaattagaaaaatcataaaaaaaaataaaccaccagtatttaaaattataatagtatttgaaggtatgagaaatatggtgtgccttgtggacttcctataccttattttcttaaactttcatttgacaaaaaaaagttacaatagtgtctttcttttgtcaaaaataaattatatgttgcattacattacattaacaaacgtttttttataaactcatatattataaatttataacaacttatacatactatttatcaactaagttaaattctcttaatgcttcaattgagttatatattctacactattacacacaatttttttaaaaaaaatatagtgaaaatcacaggtgcttttcccttttccaattcttttattgcgttatcaaaccttcctctcccgttttttcaatgcgctcatcctttattgttattgtgttgcttattcgcataaacatattgtatcgttattgaattcaatttcatggatctggtgttgtttcttcctatatcgaattccatgcaactgctttatcagtgggaaactgatagaaagttgtttttggaattgaatcatttggtacatttaattttggttttcgactctgattgtgtgtgtttagagctcaatgctcaacttgatgtttggaatcgtatttgattaagtagagttttcacccaagctttattttgaattttttatcgcttagttgttaatccctcattaagggggtcaaattggaataactctttgttttattgaattctagctttgaatgtcacttttaatgggtacttttgtataatgtggtgcattttggtgccataatagccatattactttttagagtaaattacactcccacttggatattttttcttatacttgataactcttcttttttacaccatataaaaacatcatgttacttgatatctcctaaacattatttaataatttaatagaaaatagacacatgttagtcacatgacttttaatgaaaatttatgtctaaaacatcctcatcttcttcctcaaaatcacatcttgaattttacaaacccttattttcttcaacgacccctcttcacttaccaccaccacctccttctcctcctcctccccctcccacggcatcatcatctctttttcctcattgtcgtcctcgcccaacaacacggtgtccaggtacacccactcttgctggaacaaccaccaccaccgtagttaccgccatatccacttctaccacctcctcgtctttcgccgtagctatgaccaccatcaccgttgggtctggtttcctagaaattggcgttagttaacaacattatcagaatgtggtaaaagtaatgtattaaaagggaggggtatcggatacaatttgagaaaaaacataggggatgcaagtttaaattaatataacggtcaatttcgtcttctcaaatgtttcaattgaaattatttaacaaccttaataaaagggggtaaaagtaatgtataaaaaaagagggatatggagtgcaatttgggaaaaacacgggaggtgtgggtgtaatttcctctactttttatctcaattacttgaaatctgactctttaaactgagctattttgtttcattttttgtttgtaggttttatgtagctagagtttagtccctatggtagagatggataaagtgtctgctccttcctcacaggagcgtgcacaacgcctttatgagaaggtacacctctctctctctctctctcataattatcacggatgttattactggaaaagagcttatccatgtgaatctctcgtaatctgccaaatgttaaggaatctggttaatcttaattaactcaattgtactcttggtacagtgtatctgcatatagaagtttcactttggaggacatttattggtgttcattgatccttttagactttagaggtttgggtttgattaattggtgttattgttcttcctctaatgggaagataaccccactttgcagggttgggtttgctctctttactatgacattgtttggaattattgctggaccttgttattagtaccttctggtgtatactattattgccaggaaatgctgcatgcttggtgttttggccctttgatttaaggtagcctctggcaattggcatacagccttacactggttagtaagtgcttgtcttgttcttgagttgtaaattaagaacccataagttgctgttgtctgtcatggcaaaccatgtagaacgcataacctgtggttttttgcgtgctgaggcttacttgttcttctgattaacttgataagattttttctttcttttctgtggaatgaatacaaaagatatatttttaatctcaatatttttctcacttagaaccttgaattggagaataagcgaaggagatctgctcaggcacaggtcccatcagatccaaatgcttggcagcagattcgtgagaattatgaagcaataattcttgaggatcatgctttttctgagcagcacaatattgagtatgctctgtggcaattgcattataagcggattgaggaattgagggcatactttaatgctgctcatgcttctgtaagctcaaaatcatctcagggagggaaaggtcctgttcgacctgactggataactaaaataaggctgcagtttaagactttcctttcagaagcaactggattttaccatgatctgattatgaaaatcagagcaaagtatgggcttccacttggttactctgaggactcggagaataaaattgtcacagagaaggatggaaaaaaatcttctgagatgaagaaaggtttaatttcttgtcatcggtgtttgatatacttaggtgatctttcacgctacaaaggcttatatggtgaaggtgactcgataaagcgtgagtttgcagcagcttctagttactatttacaagctgcagctatttggccttcaagcggaaatccccatcatcaggtttttggcattcctgtctctcatgtgctttgcttttggttgttcacatttgttgttgatcacggtttgtagctattgtattccattttgacaagtctgttattttcagcttgctttgttggcttcatattctggggatgagctggcagctatttattgttattttcggagtttggctgtggatagtccatttacaactgccagggataatttgatagttgcatttgagaagcagagaaggtaatatgaacatggggatgaactggcagctgtttattgttattttcagagtttgactgtggatagtccatttacaactgccagggataatttgatagtttggcatttttttcatctagaagtctcaattgtttgagatgtatcttgtttttgtttttttatgtgtttttgcttacttgcaaactttaagtatgatgtttcaagttcagtcttttctgctacttgtagtgtttggtagtcaaagctaaatgcatttggaagtttataagttgtaaatttctcactggcttgcaatttattcaaggattgagacgtgtaacgtggagtttgtgtatggcattataagtatgcaattatatttgatattattgaaaactgcaacctagcataccttttcacataaaggagttctgtttatttggcatggtagggggtgaagaattagctcttgagctagatcctctgtttattttcatactgtggtgtgtgttgttgactcttccccttttgtcatatatatgatctttttggcattacttctaactatctattttataataccatgatagaatcgtcaaagttgctctcagctttctggtgatgttaaagttcttgcagtcaatgtaagaggaaaaggggaagcaaaactcatgaccagggatactggtgtggaaacctctcttagaaagggaggagcatccaatatacaggacacttacaaatccttctgcacgggccttgtccgtctaaatggaatcttattcactcgtacaaggtatatattaatgcacaaattctatctgaccatcatatgcataaaactattaaggattattatattctgacttttttccttttctttgtttctcatatattgtgatgatagccttgagaccctcactgaagttctctctcttgttagcgctgccctgcgtgagcttctatcatcagggcaagacgaagagctgaattttggcacagatacacttgagaacaaacttgccattgtcagagttgtttccactatcatatttacagttcatgatgtgaataaggaatctgaaggtcaaacatatgcagaaattgtacagcgtgctgttctacttcagaatgcattcaccgcagctttcgaattggaatacaattataaacggtcaacaaagcaagctgaaaataacagacttgtcaaacaatgagagaccgtttaatcctaaattataaatcacatggaaagaaaaagactttgacatgctgtatgtgtattttacgaaaaagataatatggattaattatagtgtctttggattttggctttaaaattatgaataaacataatgagatgagttaatcttgattttatctaaaacttgttaaatgattcatgactcgcagcgtagtaattttacacttttatataatattataactttttaagataacatttatttatttttattatcattataataaatatttatgacactttaacaaaaccatgataataaaaaaattacaataattattacaaaaacatattagtgttaattaaattataatccattaattagtaaaagatataaattataagatgaaaacatcctgagttttaaaatcaatactatctggattaattagggtcggttcaaaaacttctgaatgtcatattactatccaagatctaattacctgttttttctaattgtatgtgcttgtttgttcttccattttctccgtatagattacgaatgttatagtagaacatgagtagcaatatagagaaaaataaatgcaaactaactaaatgataggataaaacaaaacaagagagatcaaatttaaggtattgtgtttgtttgaggaagataatcgcacacgaggttgcaatcagtattaaaaaaactatcttcaaattggacgattcaactactgaactggtcaactaacatgtctgaatgttgatcagtaggctactggatcgatttgcaattggtcaatagactatcttttagtttctttctattcacaaactcttttttagcttagcaaaacttgaaactaattctttaaaaattaaaactaattttggtttagtttagttcacaggaacaatttggtgcaatctgtctatttttggttcagagcaccaaaacacttcagttcgattcagagcccaaagctcaaagcccaagtatgaaagtaaattatatgcacttgtgtaaattttccatgcctttctttaatttgctgacataaggggattagagcttatcattagcaaaaatgggttcactacaagaaaaatgacatatgcttaagacttttgcctacaaacataaattattatacataaaagtcaaaaaaattatatctatgaacacttttgcctacacatatattttatagtaagtaaagctaaaaaatacttttacctataaatatttagggtaagtaaaatcttgtattaatataataaatatataaaattaaaaaatacttctacttacaaacatttagtataggtaaaacttaaaaaatcttgtgcctacaattattcgatgtaggtaaaattcttaaaggtttctgcctacaaacatttcgtttaagtaaaattttaaacaacttatacctacaactatatgatgtaactaaaactcataaagacttctacttacaaatattgggcgtaggtaaaacctttataattaaatttactataaatttaaaatatattttatacatttaaaaatatttatttagtatgaattatagttatataaaatagtatttatagaaaatttatttcaaaaagataaaaagatagaaaaataataacatcataatttatttcaaaaaataataaaaaacttaaataaatgtattaatgataaaaagtgaaaaatataaaaattagaaattaaaagctaaaaattacttgaaataacaatttaacaagaagttacttaaaaattatttattaaaaagtcaaataaattagtaaaaaaaataaaaatttgttaaaatgtcttgtaaaaaacaatatatatcaactaataaattcctttaaaaactatactccttaaaacccttcttcattgttgcaactccacgcgccaaatctgcaaccattaagttatgctccagcaccactacgcattgcttattctcagcaccaacggacaggcgccggcggcggagccgccaccacggaggacagcagaggcatgagaaagttttgttggttttctgtttctaaaaagatatttcataaagatagaaataaaagaaatatgaaggtttagatatttagtttatatcttttattccatacaaataagaatatttagatattcattctatatctttttaggaattgaaaactgtttctgtatgtggtccatttattgaccatgtttattcactaacccattatcttatcccattcaaaattgaattctatgatggacaaaactctataaatagaactggacactctcttttttagatcaccaagcctaatcgagtttgagtgagtgagatactggaaaactaaaactttgaaggttacttgaaagttgatagcaatggctggaggtagatacctctaaaatttatttttctatttccgttttcgctgtatgatttgaatgtgttgtttatgtttgttaacatgcatattcagatcaatataaatgttttacaagtttatgtcacgacactcgcatatgaagtatgaactcaaagattcacctggttttaggtattgaatttttggagtttcgattctgaataattgaatggtccattgatttgattcaattatggttggaattgaaaatatgatttcaattttcacgtgtgttacttgactgtgtagttcctattggcgtgtgcggaattcagcactagttcattggttctgattccgcttgtgattgttcctgccatgggaggcactcatgtgtgttgttttcgtgtggcttagttgttgtttttcgtgttgtgttgtgattgaaaatttggaacaaagacagctgataatatttttttttttatcaaattgaagaaattcaagcatttaatgagggagctccagggggctatagttattggctcagctttccaaactttacttgggtatactggacttacttgctatagttactgtttgcacctttcaatttagattcctaagcaaatcacaccttaaaagtttaaaattatataatcagcttacgaaacttttgaaaaattcgttaaaattttatagacttaatacgcgacttgcattcataccaaaagtcaagtggtagaaacatattccttgaaatccgttttgggtttcaaccagagccagattacccttcttggtgttgccaatgatattggtgagaatgttggcattcttccaggactagcctctgcaacaatttattattcgagaaaacaaaggcattcttccaggactaggaccaggacttgttattcgagaataattgtagtatgagtatcaaacattttcaaatttgtgtaaaattgagaatccttgtttttttatttattattattattattattattattattattcctttattcatatttgttttcattgtattatttgattcattaattaatggctattaatagtattgtttgttaagctgtacatggagttgaaagggcctagttaattatcacatctttctatctatggtgttgcaggtatggtttgattttccacactttaaccaaaattgatatgatatgttaattttaactgagcaaacattttggttaattttaactgagcaaaataaaaagtctgtgcccctatcttacgattccgaacttacataaatttggaatccaaattataatttgttgtttccataataattccaaaagtttggtaaatgatatgatatgagcacctttacgttttgatatatatagcatacaatattccaggttttcttgcacagtacacaattttgttcacgaggcttttcctccatatatttttaacacaaaaattaaagttaacttcattttatcattttctctaagtagccaataaaaataagttaatcactttcttatccgacctcacttggtatgttgcaggaagtctgaaaaatcacttttatttaaaatgtgtccaatatctttaaatttatttatttatttaaattatttaccttagttaaaatgtttcaagttgtcaattacttgaataaagacgtgtgaattattcgtctatactcactccatggacttcaccttctgtgcaatttgcccgtgcttgctgtttgaattgccaatatggtaagcagaacctgcaggttccatagcgaacctgacaagcaaaggaattgcagtgtacaatcacaagggccataagatgtggcaacgtccagaaaataacactattgcctcagtatcatgttgcctggtcagaatctggctaagtctaaaagatttttgtcgtccgaggaattgaagtttagctaaataagagaaattgaatcacataattaagacgaccaagagattatcttagggtggaatcaagggaatttcaacacctaatcatttttattaattgatttttctagtacattattcaattgtgctcttgtttctttcaattacatataaaaaaagttcaaaaattcctaattgtttatctcttaaatcaaaagagtaatcgataatttgattgatgtattttgataaaccaaattttttattgatacaataatttctccttattttatcaattgtacaactagtacactacactagtcgtaattctcaacaaactacaacaatatatatgctggtagaaggtgactcagttgatctttaaatcactttacgtgaagtccacattgcccacagtaggattagtgttagaaaacattacttgttcagagtaaatctttcaatttaatttccatagaactaaacgtgatggaaataaagttagtagaaccgtagaaatatagatgacacaatttgtttgatgttaattaatgtaaatgtactttctattgatattcaataaatttgcatgttgtcatcgttcaaaaataaaaagataaactattttctaaatttatctttttagtttttgaatttttatttattttttaatcacttaattttttagtatatattacatttttgtttgcttggaactataataacatgcatatccgtagagagagtctcacaattgatttttaaggcagcatgacacttcacgacaggttcattccattgctcaaagttggattagtgctacagttaagagggaaagccttaggcttctactaaactgaactccaagaaaaaataataagatgaaaaggatgtattatttagatgaatagaaataaaaaggaaaaaaaatgtaaattttaattagtttgaataaataagagagtagaaaaccaaaatatggtcattgcaaaaatgttcatcaaataaaaaatcaaatttaatttgaaaaacctgaactttttatttaattatttctcaacataaaaatatatgttttgttataaaacaataatttaatttttttaaaatttaaacataagtaaaagaaaactgctaaccatttctccctccatttcatgtgtgttagtgagaaatatggtttggttaggactcattaattacaatttcatttttcattttttaacacattcaatcaagactattttttttatcacttttttctcttcattttaattttgttgtatatagtaattcttttcaaatcgagtaggattaagtctcagtgaaagatgaatgcgtaataaaaaaagcttttactgtgttatgatttgctcccttcaccaacaacatggaaggaaggggaaaagttttgaggtgggttatgcagtatagtctcaaattaaggcgggaacaataagaaaggtaatatttcatgacatagaaaatgtagaataatctcaaatttaaacacaagcttcattgttccacaaacaaataataatacagtgccttaaagttatgccaatgtctgtaattctgtaataagttagtcctgtttggacaaacgataatatctagaccacaattgtttgtcgaaaaacttaaattgaaagagaagaaacagaagtattgggaaaacccccattgaagccactacataagaaacccacttggaagtgtgatcaaatatcaaaaaggaggctgcagtgaaatccacaaccatagcagcaacagagataataagtaaccaacgcccaaaagtcaagctgggatgtagtgatatcacaaattcgctttgtgcgaatcttgatgaagtgaaatttgacaagaatgagagtaaagacgcagaagaagcaaataatgcgactgcatttgtcaatatgaagacagtaaaccacacatcggtcttatcacctggaacagtcagagcagccgcaaatgctacggtagcaacaagtgttgacacaagcatgccagaatcggccattcctttggctgtttccttaatttcttcggataacttcttgtgttcatcacaaaatacatcaattggtgtcttgcccatgttgtttctcattgttcttagttcatgaggagcacaccgctccacgaactatttaaaaatcaagagtatatgtaaatgatggtatccaaatgcaaaacttaattaatcttttcgttatcacttaataactaagcatattacagcaatatctcctaaaatttaatgtaattacacaaacatttattgagatattagcttaaaatttgaggaaatgtgaatgtaatatttttaaacatataaaaaatgttaatgtaattttttaatcctcaaaaaggagttagtataagaaaaaaaatggaattacatataattacacgaaacttgaggagaattattgtaatttgctctaataactattagatattaaatttgtaagaaatacaatttaaaagataagatattttaaaaataaatcttacgggtgatatttattgttacaaatgtacgtgtataatttttaattaaaatatattggctgtttaactattatgctaaagacaatggataacaaattttaaaaaattattacaataatcaacaaattctgcatacaatgatttctatttttaattaaaacatgttacttttaaagatttaaatcagtctagttaataaaagcctaaaatttgtggaatcttttaactatcacctaataactagagcaaattacaacgccactttacgaggtttagtaaggtttgagggaatgttaatgtaatgttttcaatatatgagatgttagtgtaatttttcaaatttaaaagaagttagtgtaaacttaaaagaagttagcgtaggaaaataaaaaaataaaattatatataattacacgaaacctcaatgaattattgtaatttgctttaataactattacatattaaattttaagaaatacaatttcaaagttaagatattttaaaaataaatcttgcgggtgatacttgttgttacaaatgcacttctataatttttaattaaaattttctatcgatctatatattgcctgtttaactattatgcatgctaaagacaatataatggataacaaattttaaaaatttgtcaaaataataaacaaatactacatacaatgatttctatttttaattaaaacttgttacttttaaggatttaaaattggtctagttaacaaaagcctaaaatgtgtggaatttttaaatttttaaaaaaagattgctagaactgatggatcccatgcgagtgaataaagaatggttaaataagaaaaactaagcaaattaattgaccttgaaccatgcgatatctctttgcatttgaatgcttgctcttaaactggaaaattcttcgaattcaactggtggaagatgcgcagccaagtgtagaatgttgttaccttcattgtccacttctcgtttcatatgctgttttaatgtccatagtatccttttaaatattcttttatgtcgaaatagcacaactaagtgcagtagattccgtccattttcggggtcctttattctcactaattcaggctgaattccaataatccactgcacagcctcaacatttcctgattttattgcatcaaacagcactgacgaaggattagttatctcgtctatcatccgcttatgttccaattggttaacttgagtccataattttttaaatagccgaccaccttctgattccttgtcgtcctccatgtctggcaagaggtatatatatatagttgattggtccaaccaatgtttaacacatgaaatcaaacaaacaaaagttaaatttaaattttattcttatatatatgaagcaccatttttttatctctatttcaaaaattatattttaatccgtaatttaaaaaaaaattgtaagatatttttgcacatgtggctcatgtgttgccaaacattaatttgtgttattagaataactcaacaaacatctaataccattattacgctggatatagatatttaaggattaattcttaatttttttatataaaacaaatatatatatatatatatatatatatgggattaaagtttcttatgttacactagataacttttctcttatacatcaaaactaaaatcaagaaacattatctttnnnnnnnnnntatatatatatatatatatatatatatatatattagaatcaaagtggaaattaatgatgtcaaataagacctaaattttagcttagcacacacaaaaataaaaagccattttcaacttgtgaaagcttacctaaaatttttggaggctttcgcgccagcatatgcaatgctgtaaggttctctttatttcttgcaatggccagagtagttggatgtttttcaaataatagcgttgccaaatctgttatatgcacaaattaagtaaaactccaactaaattgcaaaaccacgtacttagttcatatatatctccttttatatatgttatatgcacaaattaagtaaaactccaaccaaattggtctcgacgtattgctacatgaagagctgtgtctccatatttgtttggtattagcatgtcttctggcctcatacgcttaaccaactctttcacaatttcaagactgccatcccatgctgctagatgaagagctgtgtctctacttgagtttagtattagcatgtcttctggcctcatacggttaaccaactctttcacaatttcaagactgtctctctttactgctagatgaagagctgtgtctccaatcaagttttgtattagtatgtcttctggcctcatacgcttaaccaactcattcataattttaaggttacattcccttattgctagatgaagagctgtgtctccatctgtgtctggtattagcatgtcttctggcctcatacgattaaccaactctttcacaatttcaagactgccaatgtataatgctagatgaagagctgggtatcccattgagttttgtattagcatgtcttctggccttatacgcttaaccaactcattcacaatttcaagactactgtaacgtaatgctagatgaagagctgtgtctccacttgagttttgtatttgcatgtcttctggcctcatacggttaaccaactctttcacaatttcaaggctccctcttcttgctgcttcatgaagagctgtgtctgcatatgagtcttttattatcatgtcttctagcctcatacggttaaccaactcattcacaatttcaagactgccttcccttgctgctagatgaagagctgtgtctccactatcatttaacggaatgcgtaccatatcaggacatttatcaataatcctttttgattccagccactcatccggcaatatatgtatcctcagatcttcttttaaagaacctgcaatcctttcaaacttcacattataacatgtcctttatttaataatcataacttttactatttagttgcaaagaagacccttttaatttctcgtttaccctaaatctgtaaaaattctcttggaaacttgtctcatattttgagaattcctaataatttcatcatttcaaattcattttttttttcaaaatgtaaaataaacaaactcttaagacatgatctctgaaatacaccttgttgtgaatgcaatagtttcaagtataacttactcagctcttctggagtcatttcattcactcctctactttcatgttctggtgtcggtgagtttgttgaagtggcaattggggtttgctcatgactttgattaatctgaattatgtggtcatctgaaacttcgctattggagttcatgatttaattctagggaaaatgaagtgatttggagacttctctgaaattccctgttctatcggtgttgcttctttctttccagcctgcgaagcttgaacacattatatttggtggtaaagcaagagtctttaattagttttccaacttacacttaaaataattattcccaatatgacattttgtggattacagcaatgttcaatctgttcaacacctcaaccctacagttttcaaaagctttttaagttgaatgatttctaaatttgtaatattaattcttttttaaagagaataaatatattcattaaatttgttaactgaaaaaaattatacacagtaaattgtgtggattaattagcgagactcagctatcataacactgttaattaacttactctcgatttaatattaactttcttctttggacaatgatatgatcgatatctttacacacctaaaaagtaaactacacaaactatcccttaagttttgtgaaattatataaactttcttatacttttttaaacatttacaacaatctcgcttatagttataggggcagaaaaaacatgaaatgtttttataatttcatgaagccctataaaaatggttaatgcaatttattcttttttaaatgtgtaatggaagaaacacttacgcatagagatgttgcgcaaattgactcagtaaaaaaacccaaaccgaaccaatttattcaaattattttgaccaattcattttaaatccaaatagccaaattactatagaaaattggtttgaaatcgaattagttttaaaaaaaattagtttgaattgaattgattttgaattaattttaaatcaattttaaaattagaatagttttgaattgatatttgaattattttaaaaaaattgatttggatgaaaaccaacttgattaatcgaaccagttttataaaaatgattcggttaattgaacaaacttttgtacaacagtgtaattcatcttttcttaaaccagttcagattaatcaagttgatttttttcactccattatttacggatgtattgtgctttcagaacacctatttagtaaccaaaatatgaatgcatattacgtaaatacatgcaaaaataattacaaaacatgtgattaggagcatatagtacattatgggacatttagataaatataaatgtatttcaaaattcaagtattttgtaatgatattttaaatgtgttatagaagagatattccagaacatcttatggagagatgttctttcagcacacctattccatataaccaaaatatcatactttcaaaatcatatattatgtaatatattaaaaaataataacagaaagggcgcgcatttcaaacacataacgaatatgtgttgttcttctgacatacttattaacctaagtatcatatttcccagaatgggtattccacaatacattaaaaaataattacggaacatgcaatatagaacaaataattagaagtattttgggagccactcttaagtgaggaaggaggtgtaacgtaagttaatttttataggatgcaggaagaagagaaaagatacaactcaatgttaataaagaaagaaaaaaaagaaaaggaaacaaacaaaagaaactagagtggaccaactcaaaggattatgaaaggaaactagcatgcatcacagctatatatacaaattaaaggttgaaggaaagaaatcatacccaaatgtcttgttaatgaagaacgatggagataaagaaatgcccgtgggatgtgtgaggaggacccttgtcttgttgttgctgtacgttgatcagtgtctgagtgacgagggagcggtttctgagcaatgttatatgcaaagagagtgaagctttatgagacttaaggctgtggactatatataatttattaggtggtccggatcaaacacaatcaatatcttcactgttttttatatgacatatagtgttattatttttttcataaattataaactttgaatgcatgttatgtagacattggttgagattatgaatacaaagtgattccacatacactatttaattaatttctcgtggctggcccatgtgccatgacaaaaaaaaaaaattgttgaacccacatgcaaataacgtgtactgattttttgagtggggaaaaagcaactgcagtagacacagggaaaacaaacttctttacccaaaattgttaccttacttttttgtttttgttgtcatttttttgtattttaatatattcctataccttttgcatttatttaatttttgacttatttttatccattttttgaggcgtatatttgaaatgatactttagattaattgtaaagctaagcaaaatgctttgttagattcttctgaatgtcattcttttcaccttccgagaagccagaaggggtcctttattcctttgttaaaactactgcttccaagtattccatactaacaaaattcttttcccaccaggtgggggtggaatatatagataaaaattaaaaagccacaatgtcttattataaatcatgccatgaaactaatcattcaaatataattaatataatttttcttggtctctccctatctctaactaatgcgactatatcctccatttgatcctgatctacttcctttcttccatgacctgcgttcagcacaaaaaaagaaaaactaaaaaagaaaaacaaaaacaaaactaagccaagactcctaattgttggaatacaagtctgagttaaagtcacacatcggatagaattagaaaagttgaatatcatataagtgaggagaagacccataaacccgagtcttaaggttttgagttaaagtgtggtgtctaaattcacttatatggttgctcgtggaaatccccccgatgtttaccctcctcgatttctcaacaagtggtatcagagccgatggttcgacccgtccatcggctcggacaaataagaaggcggattcctgaacatggaaatcctggatccctgaacatggagatccgttgtatcgaaagtcttcctggtggatgaggccgttgtattgaaagtcttcctgatggatgaggtcaggcaacgagtcccgcaagtgttgcggcggtacaaggtggccactacttgtaaattgaaaagtgacttctgcttgagggggaggctaccatgtggaagagactcacacttgagggggagattattggaatacaattgtgagttaaagtcccacatcggatagaattagaaaagttgaataccatataagtgaggagaagacccataaacctaagccttaaggttttgagttaaagtgtggtgtctaaattcaattatatggttgctcgtggaaatccccccgatgtttacccccctcgatttcccaacaagtggtatcatatttgttggataattttcgtttttagttgactgatactttccgtttttatttgattgatagtttctgtttttatttgattgaccaaatcaaataatatttgatggcttaggcccactccattgtaaacccaattcatcctataaatagatgagtaagggtggaagcaagacacacagaaatttgagagcctcaagtgacaatcttgagtgacatatttgagcgagcctgcgtgctctacatttgagaaattcttagagagtttgagtgaaacactctaggtttcgtttgagtaaccaccattattggagaggttgagtgtaccaccaaattggtgtgttcttaattcattataaccgattattgttatagtggatttttgatactggactaaatcccgtgagtttttccttttttcacattgaggaaagttttctcacgtaaaataaattctgattgtctctctcgctccctttgattttatttccgcttccgcaatttgatatttgaggtccgagatacccaacagtggtatcagagcccgagttcgatgggttctaaagaagtctagatggagaccagcggcataactcacgacggagatatgttcaagttgaccgcagataacttcaactattggaggttgatgatggaggatcatcttatctgcagggatttatatgatcccatagtcttggaggagaagccgactggcaagttagacagggattgggagatcctgagtcggaaggccgtggctacgatcatgaggccgtggctacgatcatgaaatacattgacaaaagcctctttgagcacatgtccaaattcacgaacgcgtacgagttgtggaacaagttagagtccataattcagaagaagactcctaggaacaaagcacatctggtccgccgacttgtgaagctagagtacaaggacgacatgagtatgatcaagcacctcagcacctacaaagaaatagtgaatcaactgtccaaagtcaacatgaagattgatgacgagatgcaggctttgttgttgctgagttcgttaccggaaagttgggatactttggtggtgactttgagcaactcggttctagaaggaaaactgacgatggatgctgtgacagacagcctcctgaatgaagaagccaggagaagagaacgaggtatatctagcacgtttgaggctaacggtgctgagaacagaggaaagaccgactctcagggtcgtggcaagagccgagatcgaggtggacgagataagtctagaagccagtcaaggccaaagcatgacttgaagtgcttctagtgtgggaaggtaagacacaagagaccagactgcaggactctgcagaatgatgaacaaaacggctgtgtgaagctgaatcaaattgttcccagaagaagaagtgatcagagcaccacagcggtggctgctaatccgaatgccgagatattcctactcagtgaggaaatgttgaacatagcccatcatgactgcacctggattgttgactccggtgcctcgttccatgtcaccccacatgagggattcttctctgcttacaggaagggagattatggtgtcgtgaagatgggaaatcaggtgaccagcaggattattggtgttggtgatataaccctgaccacagacacaggatgccgggttacgctgaaggatgtgaggcatgtacctaacatgcttttgaatttgatctcgattggaaaactagatgatgtcgggtcagtaaattactttggagaaagtagatggaaactgaccaagggaagcttagtcgtggcccgaggaaagaaagaaggctccttatatgtcatgcaaggaaagacaccataagcttggagctgtggcacaagcgcctcggccacatgaacgagaaaggactctagattttggagaagaaagagctattgaccgggttgaagggtcaagtgttggagagctgctcgcactgcctagctggaaagcagcaccgagttccgttgtgagaccggatcaacctaggagacggaggtgcattcttgacctcgtccatactgacgtgtgctccatgttcgagagatcactcggtggagctcattactttgtctctttcattgatgaccattcccgcaaagagtgggtttatcttttgaacacaaaagaccaggtactccaatatttcaaggaattccatgccatggtggaaaggaagactggcaagaagttgaaggtggtcaaatctgataacggtggtgagtatcgtgatccctttgaagcttactgtagagaagccgggatccgacttgagaagacgccccccaagactcctcagctgaatggatgtgctgaaaggatgaaccgaactattgaggaaaaggtccgaagtatgctatcgaatgccagattggcgaaagcatattgggtagaggcagtgagaacagcagttgatttgataaatctctcaccatcacgaccgctggatggagagattccagaggaagtctggacaggtcggagagcgacctatgatcacctgagcgtgtttggatgccgagccttcgtgcatgtccctaaggatgaaagggcgaagctggatgcgaagacgaaggagtgcatttacctcggttcgccaaaaatcgagtttggtttcagactgtgggatccaatcaacaagaagattgtgagaagccgagatatagccttccatgaggatgagaccattcatgacatctcgaaacctcaagtccaggttactgtccgaagagaagaacccgcccctcgtgaaagtgttgaagcagggggagaaaccagtgaagaaatcgctgaaggcggtattgtagatgatgaccagcaagaagctgatgatgccgggatccgaggtgagaatgaagaaccgggttctgatgaggctgaggaaaatagccgagataccccactcgagaaagaataccttctgcaaggtaccctgatgatgaatacaccatcattgctgaagatggtgagcctcagagttatgatgaggccatgatgaactcagagaaaggagaatgggagaaggccatgcaggaatagatgaaatccctgcatgagaatcagacctatgagctgaccaagctaccctaaggaagacgagctctgaagaataagtgagtgtacaagatcaaacaggaagagaacggacagaagtcgagatacaaagcccggattgtagtgaaaggctgcaatcagaagaaaggagttgattttgaagaaattttctcttctgttgtgaagatgacctcgatccgaactgtgttagccatggcagctaccatggatcttgaggtagaacagatagatgtgaagatcgcattccttcacggtgagctggaggaggagatatatatggagcaacctgaagggttccgagcaccaggatgcgacggcatggtatgcctgttgaagaagagactctatggcttgaagtaagcatctcagcagtggtacaggaagtttgattccttcatgacaaagcacaagttcatgaagactgaagctgaccactgcatatttgtgaagaggtatgagaacggagactctctgatccttctgttatatgttgacgacatgctgattgtaggacaagataagatgaagattgctggattaaagaaggcattgagctcatccttcgctatgaaggacctcggccctgcaaagcagattctcggaatgaagatcatccgagacagaacgaagaagctattgtggctaagtcaagagaagtatgttgagaagatcttgaagagattcagcatggacaaagccaatacaagcactcccctagtcgggaacatgaagctgagtaagaagcagtgtccgatgtctgatgaaaacaaagacaagatgctggagatcccgtaccaatctgttgtcggaagcttgatgtatgcaatggtatgcactagatccgacctggcatatgcagttagtatgatgagccgatttctttcgaatccaggcaaggatcactgggaagcagttaagtggatctttaggtacctccgaggtacaaccaatttatgcctccgatttggagatggtgaagccaagctgcaaggctactcggatgccgatttggggggagattccgactcgaggaagtcgacgactggatatttgatgagatttgatggagaagtagtctcttggcagtcaaaattgcagaagtgtgtggcactttcaacgactgatgccgagtacattgtcgtgaccgaggcaagcaaggagatgttgtggatgaagaatttcctcatggaactcggccatgaccaagaaaagtacaagctgatgtgtgacaaccagagagcaattcatcttgcgaagaactcgacgtatcactcccgcaccaagcccattgatgtgaggtatcactggatacgggatgcggtggaggatgggaagctcacacttgggaaggtgcacaccagttagaattggtctgacatgatgacaaagccggtaccagcaataaaatttgaagattgctgtgaaggagttgggctgaggaactcggcatgatgaagccgaggtgagaaggccaagttgttgaaattgaagacctcggtcgcattggaaaaacggaagggggagatttgttggataatttccgtttttagttgattgatactttccgtttttatttgattgatagtttctgttgttatttgattgaccaaatcaaataatatttgatggcttaggcccagttcattgtaaacccaattcatcctataaatagatgagtaagggtggaggcaagacacacataaatttgagagcctcaagtgacagtcttgagtgacatatttgagcgagcctgcgtgctctgcatttgagagattcttagagagtttgagtgaaacactctaggtttcgtttgagtgaccaccattgttggagaggtcgagtgtaccaccaaattggtgtgttcttgattcattgtaaccgattattgttatagtagatttttgatactagactaggtcccgtgagtttttccttttctcacattgaggaaggttttctcacgtaaaacaaattctaattgtctctctcactctttttgattttatttccgcttccgcaatttgatatttgagggtccaagatacccaacactaataagacatgaattagccaaataatattactaagattttcaatctatatcaatttttgttatgttcagaatacagataagtatttttcctagacctacagtccaaaagcacatagagaaagagtcatttactgagaaagtgataattctaaagaagcatgcttacttctctaatggcacatgcatcttcgtctttgctctttttcccacgaggaaaaaataagctaaaccatgaatcatcaaatcaatccagcacgtcattgaaaaataaaaaatgaagaccaaaaacataggaaaaagtgtagaacacagtatcatccccaattagtaactatttggcatttcataagaacaaaacgcacttgttgaagatccagagcctccgagaagagcaccatcgtaatccccggccttccagaactgctgggagctattcagactcaaactcttattcgcattggcgcgcaatgccgtcgaattagaagcccattctagcgccagtaaggacaacatcgtagtgcgagtaggcgcgggcaccggagggagacgcgtgaggaatccaactggcaaaaccactcctccagcctcgctcatcctcacttcttggacggactctctaccgaagaagaagcatcgttcactgtgttggcgactgcactgtccaaatcatggtcctcgtcttcatccatgtcggaatcgctgagttcaataaccgaacccagaaggggccccgaaacgacgccgtttcttggcctcctctcggtggcaatcggagtctccaaaacttcttcttttacgcaaacatccatggctggctaaaacgggagatgaagattcaacaaacaaacatgtaaaataaaaaatataaaagattgaagttggaaagttaaaatctcaacgaatgaatcaagtgaaggtgatgggaatggttgaactaaaaaggggatttggctctcgtagaggggaggagaagaaagacgcactccgcccttgatccagggaatatccaaatgcagcacgaccacaccttaacggcagcgcgagagttccacggcggcgacagtcgacaaagactacactcccaccaacccatgatcattccacgatttcaaaaaatggagcttttgaagcgaaaccctaaacgagagtgaaaagtagcatagacatgaacttcaatttggtttcatagctttaaaatcaaagacagttctccaaaaccgtcttcaatttgggatcaattaatgtcaatgcataacttgattaatcttttaattaccacttaataactattacaagtttatgatattaaaaataaaaggaattgacctagcttgaaccatgccagctagctttctttctatttgaatgattgctctaaaactggacaatgctttgaattcaagtggtagatgagcaacttataagtgtagaacggtgttaccttcattactaaaaaaaaatgcttattttaattccgtccattaatgttggggtcccttatcatggtcacagtttactatcatcgtcaagaatccaactaagagcctcatcatttcctgatattagtgcaacaatattaatatgcaatagaggagaaaaatatcttaaaacaaaatgagaacaaccatcaacaataaataaatgtaacaagatcacgccacatatttagaaaaaaattttaaaaaaagattttgaagtccttaaatttttatgaatttatataaataattaaaaataaaaaaattaaaacgtgactttcaagtgactttgatgtagttggaatttttatgacttcaatattaaaataaaataaaatatcaaaatcgtaattttttttttataattttatatttagaaatgtaaaaattctacaatttatttctatttagatattaattaaaaaatacttccatttggcaattctaagttgggtatagatggaaagatgcagtggaaaaagagaaagaaaattcggaagcacgctcaaactagcatatcatatcttacttttattttattattaattatatacttttatattttcaatttggtttaattatcctcttgatctatgtacttgtaacaaatttgaagttatatttagtttttaattagtccattgatctattttattaacatttttattttaacttttattataaattaaaacactaatttatatatattacaattttgaatgaataaatatatacataaaaaatattattgatccaatcctaaatataagactcttttaaaaataattcacattttttaaaaaattaattaatttagttattaacattatatttataaataatgtgtattatttttaaaaaaattaccattaaaactttcagatatcatcattttaatattttacttaattctacctacttaattaatatgtgctagctaattatctgaatatctagttctcgtaatttagagagaaaatgaatttactatgttgttattagtttataatatttattataaattatttaagatattttggtaaaaaattaatgcaagagataaattaattaaaaaaattaacaaattttaaaaaagaattttatatttagaaatgaaggtagtgaaaaaattacaaatttatttttatttatcacaagatatattttcctatttacatggttgaataaaaaatataaaaatgtaactcaataaacaatcttgatatcttttagaatataatgcaatgttgcggtagatcataaaatgaagaagcaaaagaagagaaagaaatggactgaacgagaacggaaaacgaaatggacatgcaaagttagcactcacattatttattccgtgggaacgagtggaatcgatcggcaaatgtttccctccatgctccatgctccatgctccatgctccactcttttggcttaggtttgctttgcccaattcattgtttccttgtgtcaaaatcaaaattctatttcagaatatgtgtgctttgaatattattcggttaaaagtatagaaggtagcacaaatcaggtggcacctcttatatgtttgtaattgaattgattacaattaataagtaaaagatacaaattataagatgaaaacatcatgagttttaaaatcaatactatctggattaattagtgttgcttcaaatcaaacttctgaatgtcatattactatccaagatctaattacctgttttttctaattgtatgtgtctgtttgttcttccattttctccatatagattatgaatgttacagtagaacatgagtggcaatatagagaaaaataaatccaaactaactaaatgattggataaaacaacacaagagagatcaaatttaagtaaatgattatttcacgtaaatgataattatttcccataatgatttactcatgatgatccaaagaataattatttcccataaatgataattataattttcatcgtaaaaaaattaaattaaaattagtttacattatgatatagtgaataagtaatttacaactttttgtaacaaaaataatttttataaattaattataatttttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttatttattgataaagtaatttaaattaattaattttgattgtcctataacgaaaattcaaattattattttctaataaatatattgactaaatgttattacactgattataataaaaattgaattaaataaaaagagtttaaaaattccaaatcttgattaaatttaaataataaaattataaatatttttatttacaatatagagtgagagcatagaggtaccaattgcaatacaaactattaatttaatatttgattatgctcctcaaaattttagttaagggtcccaagaattcacgttatttggattagtagcctatttgatgcaattgaaggcattttagagagcattggcaagcttatcgtatcatttttataaattaattttaaattgtcacctctatattttattgttattaactcattattttatacaatgaaataaaaaaataacatctttaatattctaaaagaaaactttaaataaagtgattgatgaataataagtaggatcaaataataaaccagccaaaatcattgatattaatgacaaataaaaaaaaaaaaaaaccaaactgattcatagacttaaataaaaagaatatttataatattatcctaaccatccaaatcaaagctacaaatgagataaaataaaacatgcaattcttttttttacacacttggatggcaggacaatgaaaagtaaggacaaataacgtgtatatgaggtgtgtataatattctagagtgtgtatagttttcattggtggaccacatgattgcaaggttttggagttaggcagcagaatggcagaacatcatgcaattaggttgcttttagtgagattcacttcatacaaggaagctggggatgagggacctaaacaaaactcagcaacatccaccaccaactgggaaaaagaaaaggtatttacccttatgaagaataaaagtttcttatatccctcttcaatttccaatcaaacaaaagggcttttttaaaaaaataaaaaatctgtgttaaatattctgttcttaattggtttagccaatagctagaaacaacataggaaaggatatcattaagagccagccattctcacaaaagggcttgttcatcacaattccagtaaaaataatcattaattttgtgtcacaattttccctttctttaaacacttgtacatttaaaataagtttccaaccatacaaagtcccaaaaaatcatatgaaaagattacacaagggaggatgggagaatgttgaaaaataaagacttgcagacaaaacactaagctcaaaataatcatatccagcacatatggggcatgaatttaatagtgaccaacaaacttatagttgacaatcaggtcacatccatcatactaaacaacaaccctgctcggtttgcatgccaccagtccaagacgtactatattttgtcatttccaacacaactttgatcctgctgatagagatcgggtcaaacctggttcaagacatataccaagtcgcattttagttcaaaagtgtgtacttgaaatcagagttatagcatagacattaaacatcaaaataacaacacataataaaactaaaataatgaattccaatctcaagatgcagaatactttataagtaaaaaccatcctccttccctccccctttccactacacagacaaataaagaagaaacacattaaaaattcaacaggttctgaagtagtgcagtttagagagtatagcatgatacaaaccttagagatagcctccaagcagcacctgacttgtcattatgagcgacacctttactattagatgcacttccatagatatcatcaaatccatcatctttggcattatcccatccagcccaaccatcactgctatgggcagctgaccctttagctggtactttcttccttgcatcttccataaaatacttgaaccacaaacagagataaaaaaatacataagtgataaatgttatgattaaggaaaatagtgagtgctgactaaaaaaaatgcagatctttgctacaaagggaacagtggaactcacatagatagatatgtttcatatgtttaatgaataattgaatagcaggatttttttagatttcatagaatattttaaatttttttagcaaaacataggtaatgtaaatttagcaaagctggaaggttaaatccttgaacattaacattatcaacttctgccccccagttatgcatcagtcacagaattgtctgcctgtatggttctctctattctatattgaaggtgagtatattaaccacttgaattttgataatgtgatctgagtttcatcttggttaacagaagtggaactggagcataccttcatcaatgtatactacgtgattcccgtgcttggcactgatttgtggggacatatgagtagcctttaaggctgagatatacaccatattactcttcaataagtaagctgaggctagaacataacagtcatgccaaatatgtaaccagcagcatgaaaacagagggatgattcactatactatcataattataaatattctagggtgttttcttcttctcttgaaaaatgatttttttttattgtgcttttgggagtttctatgaattatctctgatttatgattatttgtgtttatgtattgctgctagagcactagagttatttctgcaagatttgtgtgatcgaacatatgagatgactttgaggaggggggcaaagactatgaatgcttttcatttgtaagtgaagtttctattattttcttggttcaaatttttgtctatgtcaagtcggttcaaggtggttacaaggctgcaggtttctttcttttggagggcggttattactatgtacaattctaatgataatgtgcacagtctcaaacaatttccttcttgtgccttctatttatcacattcacaaacatgattagacatgtaaatgacatctgcagaagaaaatttcgggatggtcttgcttttggaacatgttttttgtttagtgtttaccttcactttccagtttctaaaatgtctgagttacttgcatccttgcctttgcagaaaccagcgtgtgcagacttttaatgtctttgattttctgaaagatattgtatgcaaggttcctgatttaggctgttctgttgcaactggtgatgaccatgctgtcactaagaggaggtctgtgctctggtcaatattcttgttacttggaacaagttttctgtatgctgaactttgtttactttatattaggaaagttgccgatgatgatgataatgacagcgacgaggagctcaagagaaataagaaggtaatttataaactgtattcaattacttcatcagtggttagcttaaatttttcttgtgtgattgaaccttttgctgagtaattatctcttgtccatgcacactgtgaatcttttcctggatacaaaaaaaatttacttcagtcaatagggaaactcactagtggcttgtgaatgcaagtacgtctaaatgtctaatagtctgtgaggctaggccacacttcaacttaaaacttattacacaaagcgccacaactgtctggttttctgaaaacttttgctgaaaactatagaattggcactaaagaacctggcagctgtttaatattaaatattatctgacttctggaactttgttttttttcttcatgatttgcacagccagagcctggatataagagtggcagagggaggggtaggggcagaggtaggggtaggggctgtggaattagacctgtatatcaagaggtgagttcacatgccaagtgggaagatgattctgatgaattgaagcaaaatgacaaccacactcaaagcaatgaaagcatggaaaatgtgccagaacctgaagtagttaagcaaagttttccagtgagcaaaccggcttaagtgtccattcgaaattttgacttaaatttggacccagatgaggatatggattcattagacaccccaacttctgtcccaatgatgtgttgctaacacatcttagatttaggctaattttaggttataatttaattgaataagtaggaatataggttagaattagcttagttgttatttacattcaatttgatctcatttctttaccaaggtataatttcagggctaaaaaggaggagaatcaagccaaagaagaagaaaaatcaagatgaaggtctcgcgcggttcgcgccaagcttcgcgcgaatcgcgccacaatgaaaatatcaagcctcaagttcgaacaagtcgcgcggatagcgccatgtctcgcgcgattcgcgtcaaaggcccaggatcaaccatgcatctcgaaccatccacgcgatcagcgtggattgccacgcgattagcgtcatgaagccgaatgatccacgctatcagcgtgaagtctcgcgccactagcgccagaaggtctgaagacaacctccaactcgtgccatccgcgcgaccagcgcggaatcccgcgcgatccgtgatgcgaagacgctgtttccttatttgaaaagatttggttcgaaaattgggaagaaaaggggcttctgttactagaattaaaccatcttgaaggcaattataaaaggaggcctctgaactgaagaagatcatcatctatcatcttttgatcattctacacctttggaaatcattcctacatagaatcagaagctagggtttgctgcagaagaatgtttcagttgacagctttggtgttcctgatgactatgtcaggctaaactctgtattgtggttaggccaagaaccaatatgaactcctttgtaatttgactggtattgaatgagattactatgattgctttattttctctgttcttcattgttatattctttcttagaattggtcattctatttaagttctgagggttagaattcgcaatagggatgttgggattctaatttctgacatgagtaagataacaattgttcattgcctagggataggaatgcgtgattgcagaactttataatatattcttttaaatgcttagcttgatagaaatcactaaggaattagggttttgattcaggttaaagggttaattcgctaagggattagggattagctaaattagaaaagatttattctctgattaatcagaagcaatcaactttgataaccagttaagtgaaagaggcaggaatcaaaggggattgcgtcctaatcacaattattcttccattggtttacaactcactctacttgcattttaattcgttttaatttctgtcaattacttaattgttcaactctcaacacaacaaacaattctttcaaaaatcgtttcttttcccttccaattgcttagactgcaaattattgtgaaatcagtatcaatttctgtggatacgatactctacttacctactctattacttgaaacgagcgatatacttgccgttttcgcaacacccaactagttcatctgcaaaatcagtgtcagaagagaagcatgaggaataccctggatggtccttgtctgaaatggaaaaaatgaccattgatcccattcaactagcgaacataaatggaaggattgatgaagatgaagaggattatgatgaagaaatgtagatgaacctgtgtcggtttattaattacttctcatatcagcctcaaatctcagatgattttgttatttcctcctattcaggtatgcctaatgcagaagatttattgaaagacaacacagtagtagacaagacaaaagtcggaattggtagtccagaccaccatcagtacattgaaggagaggaggatgacgaggttatgttttcaaacctatagtagctgagaaacaagctgatgtggttgtttcctcatcacgggcaccccatgaaggcttagaatcagcttcaacagcttctattggggatataaaatttaattttaattcttcttctaaccctctgaatgatgtgaatcatcaaatttctttacctgcttctgttagtgctatggtgcctcaacacctgcaaccagttcagccacattcttcaaggtggtggttagaggaggaaatatctcttgctaacagtttgaaaggtcttagattcttggagaatgggcacgtgatgaaacctgacttaccatttaaagcagctgcggcaatctctgactatgctgcacttgcagttcctacccagcaatctgtaagtgctagtactagtatgttttatgctcatgatctctcaaaagctgaagactttgcaatatcatccaaaattgaggccattgcatcttctggaacattcactgataactctgttgtgaaaacatcatcaaccttgcaagctggtttgaaaaaatctccagtcagccgaccttctaggcaacttggtcctcctcctggtttcagtcctgttcctcctaaacaatgtagtgaacccactgtttcagattcgattagtgggaatccattatggatgattacagttggttggatggatatcagttgcctgcatcaaccaatggtttaggccctaatggtcctcgtactctcagtcaaattctcatcaagttggtaacaatggtttgagtgggacagccagttttcccttgcctggaaaacaaattccatctacactgcaggtggagaaacagaatggttggcaagattttcagacttcggagcttttaaaagcacaccataatcagcagttgcagtcacagttgctcccaaatggaaatcagcattttactccactgcctgatcaatttcaaggacaatcaatctggacaggtcaatacttcgtgtgatgctgctcgtcagtatgagaatattgatggtacgcttcccatctggatttattggtagggctattcataaactgctgattatatttcagatttgattttgaaaacttacccaattcaaactgaaattacacacacacatattattttaaaatttatgatagtactcatggttacattttcatttcttatattttttttaaaaattatcacataacttaatacttatttatgaaaaatgtttaattaaagataaaaaattatttacttgagaaaaggttgttaaacaagatataatggagtgagatatagattgacggacggtatgttttaggatggagtggagaaaagttataagcttggtggagggttaaactcattagtagttctatgtttccgtagttcccttatttttgttatctttttcttcattttttttcctcttccttcctttcactagtcttttattttagcttatttttttctctgttttgtcttatttctacttttttcttcccctctcccttttctctttctttgtcttatttccgatttatcattgggtttatccagcaccgaccccaattaacttgggttaaaggtgttgttgatgttaatgttaatgtttaattaaagataaatatgtagtaactatgtgagtactgaccaaaggtatttaaatataattattaagctgtgtaaatttatttttaatagtatatatttgaagagttatactactattagctatacattgacttatagatgagatatttgatattttaaattattttttattatatttattatgtgttactatttaaaaaatgaaagctaattcgatccaaactgccttatagattggattggaatcatttggttgaatttaaattttaaaccaatctaattgaatgataaattaagaaaactgaagtaactggactggataatattgctgtttctttgaaggatgcctttcattttgttaattttttggattgctaacataattacatatttgaggtcctcgaaggattattacaactaccccttcaaactccaactctactgccttgtcattgaattttgttggagtttatctggcctagacatgttgcaggaggttgctactacaaaaaggtgggtaccaaattttttactttactcattatgtttaaaactcgcaaaaattgaaatttggacaatttgtgtgccacacgtatccacctcctctactaccatcttcataaacagttttgggatctactaggattcatggctgtatgttctgaactgtttatcggtcattatgtgttaactgctgaacttaatcttacataatttgcttgtatattattttagaatttgctgagctctcaagtccgggtgatcgaagataaacaagcatctttagggtggatagagggtgataaataaaatctagtcatcttggagcttgtatgtatcttctaagattggtggtatggctatggtttgttcacttctccagtggaaatgtcataatggtttgccatgcgcctgtaagaattgttaccgtcatctagctgccggtgatacatgatgctagcccctttttttactacctcaaagcttaagactagttgggaagattggtaggtatgaagctcgtttaagttggataatgggatatgataatgactttgtgaagcatgcttgagtaagcacaagtgtctagtggtcgcatctttgttaagattcttatgtgtttatataaccagtgatatatacatacggtttactttctcccttaaaagcttttacctagtcgggttttactctaacttatgaataagtaatccttgttggatggtggattgtggatatgtcttggtctatataggaaatatatctatctaaagtagggatttgattgtctctatttactgctgctgtgatttattgcttttgttgttcagaagtagcatgcagcagttacttacatgcaattcctttgtgttactgtttgtctttagtttaacaagaaataacagaaggtagatggaaagagttagactcatttatcctaatatgaacaaaatacaataaatatttaaacttgcgagaaaatgtctgtcttctcttcctgagaggggttgggaatggtagtagcttagcctgttcatcctctgagatcatcagacatttcgtttggaatttcatcatgtcgaagcgtaccaggtctttgaacctacaactgccaaagtaattgcattaaagatattatctttcaggaagacatatattaaaaagggtagatggtattggattggaattttgagtcacccaagagacagtgatgctttcaagcaagtaaatattttttgataccataactaacaaccttaaatatgcaagattacctatctctacctacattatataacttattttacctattttacagacaactagcaactacttactactttaagttgtgatcaaattatgatggtataactttgctaattatataaaattaagactctttttaaataaacttatccaagaacacttatacccaacctttttagatataattttaccgacaaaaaaaaggaaaaaaatatgaaggtaaaacaaatttagcttttttataagttaaaacaacttatacatataaacttttggagaagtcagatgaggtaccttctagaaaagtcaggtacacaagttaaaactaattcatttattctctatttttttcctatagtatctataatgaaataaaaaaaaaattgtattctaggatgaaggtgaacaatcaccaaaaaaaactctcgtatattcaccaatcttggacaactctctggtcagtaatttttcatttattttaaaagaaacaaaaataataataccatatttgtgtatatactatttccaagttatatccgttggtaccggacaatcacacaataatcaaaaaaaacagaaagagaaaaagaaaaaataacacacaatgtctatcctgattcacccaatgtggattacgtccaatttttctctatattttcctcgtacactcattacaatgcacttaaattacaaggaaatatatagtttagagtaggaccccgtccaagaacgacttatcttcttacggcaaagtatgagtcatacccaacaatatcttatatgcaaaacaacaaaaatgagacacatagaaaatagaatgtgtaattattattgttttcttaagggagagataagatatttttttttaaggaaaaaatattatcgaaaatgaaaaatgatgaataccattatgatatttaaatattattttgatttttttaaagggaaaaatattatttcaaatgaatctatttaataaagatagagatatttattattttgattagaagtgaatctattaatttaaatgaggaatttatttggaagaatcattaataataagtattaatctaaattagataaaattaagtcattaattattcttgtgtgcaacaatgcaatgttgcatacattaaaaaaaattgaataataaatattatttgatttcaaaataatttacactatctatttttatttatttttttgtcctgagtcaagaaccatgaatgtttcgtaatccaatgaattaaaagctaatttcgttcgtggtgcatgattattgctaaccaaaaaaaatttcgcatgaaaaaaatcgattacaaattctccctccattccaaaatgaatgaagttttcacatataatttttttatattaactgatatgttcagtttccaacaaaatattaaaacttctattctaaatttgtcataaataaatgacattaatctcatacatttttagaatcttgcttgtacctcaccataatggtacaaactccttccattaaagtcacacttctttttccttatcctttttttttattactacaccgcctatgcagttgaagggtttatgcaaatattggtgcttttaactagtagagaaacattagtgaggagaggcaaagactagtttcatccacaaaagctgggggaaaacaaaacggataagatgtgattccattggttgaactatgacaacaagcagtttgcaaacagtgtaaggtcttgtatatgtttgaatgcaaaaaaatttaccggccattaaaaagaaagaaaaaaaataaaaactattttcagagaaagcacgaaacatcatttgtatttatcacaattcctatttgcttaaacttatctattttgacatgtatttgtagtcctcatctcaaaatcactggctttatggtttatcatctttccctcagcttttatttaatgaatcccattcaggtatgtttgcagtagcctcattgaccatttttacaagccgcacctgaaaatgattattgcagtatctattaattgacaaaaactagcaatcattgaagcacaaaatggcattaatgaagcttcagttaaaacacctctagtatgaaggtttagcaaagactatgtaaaatcacatcaaaaccccaccaaacacttacaaccaatctttcccattcaactgattttccattgggctcagccattgaggtccagtggtccaccaaatgctataatagatgccacaaaaacaaggctaattctaataccttgtggcttgtactaatggcataacatgacatcaatgggcataggcaacaaaaaaaaaaaaaaaactcgacataagcaacaacaaaattgcagctattccatagatcttcacaagtaaaattttggagaaacaacagccacattatcaatcatgattcatcctcatcaaaaaatagattccctaccgaaaatactcagttgatttcctgtgtatatatttgcatcctgatttcctgtgtatatatttgcatcctatgtgtttgattcggttttgcagtggtaatttgctgaagtaaatttaattatttgaagcactttgcgtgcaaaagttagaatgatatggtccataaggaagcagggggcaatggcatgcacttcaatatatcgggtttactacctttgcaattgttgccacaaactaaagttacatataatgaaccttttctttatatagccatctgtcagaaagatgaaccatcgtaaaattctttactaaattaacatgcaaaatcaacattctaaaatttaaattcagatataatgagatgaactttttatctaattatgggttaataaagcaaagcaaaaagttaaaataatggagactgaaatagaaaggtaagtgtgaaagataagtagaatgcaccaaaactcctccttttggagtatttaaaaacacaaatgacatgagaaaataggattggtcaatagtgttaaggacattttctaatatagactgtttggcaaaattgcaactttccaacatcaactgattaataatttcaaagcaagacacctagaaaatttgaagcatggacttaccacgctttcaggaactcctggaggtggtaaggggaggtttttgggtggaggacccaaaagataagatctcttgtcaaaacgccattctccaatcttcccatatgtcagttccccctggatgaagtaataaggagtagataacttacgcacatacaacaactaagcatgcaagactcacattttatacaaggacaggcataagctaaactgcaaaagtaatactaaccacagaaatataggttctctaccttactttcacatcattcttgcattaaggagaatgaactcaccttcatattatagtcacatccatatgtatagtggatgataaacttattctcgacatttaagtcccaaggtggctgaaacattccaatgatgcatgtcatggacttgtgtatgaattccttaagtaacaattacaaaacaatgcaagcaattcaaacctgaagcataaagtcttttcgaagattatgctttacaccatgcaatgcagatgccacagcataagcatacctttactcaacagagaatcaaagcagcagaaggttagacctattagtacagaccagggtccaggaaaagttataaaatgaaaagaatatcaataaatgataaacaataaaaaatgaagcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagctatttcctccagcaaagactgatgataaagaaaattcaatgccttaaatgaaagaatatgttgcttatgggaaaatcacgaaaatctgatcatagttataacagtaaccattacagctataaaggccacagtataacaactataaccaatcaagcacagtatgcaaactattgagacttaccttcttaatgattacaggagaattgccaattggatcaacatcagtaacaggacccttttcctcaggatagaatttcctgattattttttcattctcaaatggttttatatagaaaaatggaaatgctgcgggcagggttccatgagccaaattaggcaaaggatttacaaatatgtggtcaggttctgccatcagaatatatctgcaccaatcataaaatgcgctgcctcttagatttcattattggagagcataaaaattgtagaaaaccataattaaggcacttactcttcctcaatatctgctttctccagccactgaacaaaagcccatggtctatttaggacaatataaccctgcaccaaaaataaatggacataaattttgatgacagaatgaattgatgggaataatatagaaagatcacaaacaatgacattcatgaaagagttgataactatcaacagtgtagaacgtgttaagtcaacaaacatgccactggacaacatgactgcaaccaaatatgaacccaaatctaggttatcgaaactcattgctcaaaagcagcttatttgggcatacacttattgagacttgtgagttcacatactaatctcagttatgagagttccccttggctgcaaaacttcaacaaatactaccgatacacatttgacaatttggaatatacacacagtaagatgcacagtaaacggaaaaatactcactcttttgctctaacattaccttgcttagaaaaaaaatatcagttaccaaggaagagagacagtagaaaatcaaaatcactaagatattgtctgtgttactagttaggcatacaagggagacaaggatggaaacagattatttcagaaataaagaagcaaaataactgcaacagttcctatttcatctctattccctgttttatctgcatgcataaaccttcattatttgacatggacaatacgatatgcaaggctaatgaaatgtagagcccaccaaggttcatataatgacatgtggtaaagtggatcatatagtcttttatagatgtacattaaaaacaattaatatgtaacttaaacattgcactatggacgagtccccagaggcttttgcttttttctcaaaccaagatgatgctatgttatggatgtgattataccataaatgctcaaaaaatagctgcatattaacatattatctttctgcacttcagtttctgttgtccccacaccacagaaccatttttttgcatcagaccttaaacagtagcaacaaaatacttcgatataaaatcagttgtgtcaatcaccatcagcaataaaaagattaattaggtgacaagaagaaaaaaataatggaaatgacttttcaaatccaaaaaactggcagcaacaacaatcattagtaccactacattataaggcagaccaaatgcagaacaccaaatagttaaaataaccagggccataatagtcgaagaaacatgcaagatattcaaacaaaaccatcatataaaccaatcccatttccctctaaacacatctcattgcatttgcatcaagtgaagagaaatttcctccctttagaaaaataaactcttattatgtatgatgaggagaacatacgccatggtaacaaataacgatcattctgtgaattcttttagacaacatatttcacaattaagtagcaacaacaaattaaaatttaaaacatattacttcaaccaaacaatcatccccatttcccccaccccaaagttgtgaaaggtggcttactctgtatgtcaggatttgtaaatttgctatagggtcagaaattcaccaaaaaaaaaaacgcaagtttaaacgggctaaaaagatacaaattctgcagggagtaacagaaaaacatttaccttatccaagcccccaggaagtggatcaaccacaaaactaggaatctcatccatcagctggtctgaccttccagagtgcaaaatacgcgtgaacttccccatgtcggatccaggcatgtccttcactttcttataccaatagtacataatccggcattgccattgattgtaagcagcatcggttgccgtcatggcaacatgaaactttgaattagtcttttctgacctcataatttttctattaaaagattccaacccatctgccttatggtccatgatcatagctaccaaattataagtggcaaaggaaaaaagaagcaccatgagcagcaaaagcagtgactttacccgccccatgctttttctcacaaccattttcaatatcttcacctattcaaatatgaattctcagaaacccccagaaaccaacccttttaaacccccactcaaaccactttagtccttcaaactcacaactttagtgcatagcaatagccaacagacacaaacacaatcctttaaccgtttgcttcacacacaaaaaaacctgcatcataacataaagtagttaatgtgccacgtaactgcaaccaatgaaataataataataaaaaaaaaaacaaacaataaaaaccactacataaaaccccagaatctaaaacgcataaaaggtgaaaacgcatgcttgaacatgaatgaaggaagactcacgtaaacagatctgaacttgcacggcaattcagggctccccaaatggggaagactcaaactttgaatgagagaagatgcaaaagaatgaaactttggaggaaaaaaggtaaaggggtggatgtggaaaagggatttgtgtgtgtgtgtgtgtgtgtgtgtgtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttgacttttcaataacgggtgtaagtagcaaggaaggcactagaaaacgcggaggtttgaaggtggaagagactgagatgatgaatctgagtgtgtattgtatctgttgactccaaaatggaaataaaatgaaaaggaaaaaaaaaatgagagtgaaagggatgatatatgatgatggtgcggttagtgcacaacaccaaaacgaaaaggaaagaagaagaaaagtgaagaaagctttaagaaaggctgttcatggggatgcattggacgcaaatcccggtttcagacacattctaattagcctccatctcaatgaatattcatgcacaaggccactccaaaatccaaatccaaagagatgcacttgccatccacagggcatgtccttttctatcaatgttgcttttccttttgttttagtgaataataaatatattttttgtcctcgtacaattaaaaaattgttcagatttggtcctcatttaggttcgtatggcaaagtttgataactctaatttattgtgctctattttttttattattgcaagtgacttttcatatgaaaagaaatgtttttttccttggggataccccttgtattagatattagagtatcaaactcactcgatcataaatcttacttatagtatataatttttgttgattcaaagagattttgacacacaaaaataattaaaaataaatttttttaataaatatattgtttctcgcatgtgaatgcaaggacaaatctacttggtaactcaaggatcttattcaaccgattttcatcaaaattataaaaataatatataagttctgatttgttgaataatgaatttccatttttgttttaaccttattaaatattagtttattgataagtaattaagggattgaacataaataattttttattaaagttaaaattaaatcgtttaaataatatttaaatatgatctttaataaaaaaaattattagattttatttatctcttgattaaattttaggttaatcataatttttttatgaatgaatcggtggttaatggttaagaagaaaaaaaatcctttgatgggttgcgtgtggctcttttttttgttgaagatccttttgtgaactgtgtgtgacgctttttttgttttttttgttcaatatgggaatacactatatgtagtatattataagtttaaatgtatattaattgaatatagaaatccactatatgtccgtagtatattattaactgaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactaaatatacattcaatacaacctcttagtttgtttctatacttgctctagtacgacttatttatatgattatttacttaaaaataaataatagataatatgaaatagaaccaaacaattggactatagaaccaacaataagagacatttttaaatatttttttaaaaataaaatgatagtaaatgaaatgaaattttaaaaataataatttaatatttaatgattttttttacagtatatcatttttaaatttagagaaattattaagtgcacctggagcaagatattttattgctctgatccattcattgttcactatgtcagcaatctacctagaaaaattaaaaattgtcattaatttaggaaacaacaatgacccacaatgctgatatggcgaacaatgaatggatcagagcaacaaaaatatcttgatccaggtgcactaagaatttctcttaaatttattttaaaattgaatgtaatgcaatgtaagtaatttgatgtaatattacctcatgtttaaattataataatttttttagagaccatatatatcatttatgataggaccactctgtgcaataaaatacctccaaatacgtaatgcagttgcataacacacaccataagtgttgtaagtcagttagattctaggttcaattatatttttggttcctatataatttttaatatgtaatttttgcctctgaatttttaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaccccttgtaacgggtaaaaaaccaaacaacaaactgctaaataaaacgctagcaccaaacatcctcatgcttataaagaccagacaacacaaaaaggcttgttaaccaaaaaatttaaccacaccctcactaaacaataaactaaatttggaactgccttggtaccaataaatcctgatacatagagctattcaaaatcaaatcaaattgtttataaattatcaaactgatccacttaaattaaaaaattataaaaataaaaaaattcaaaaaatcacatttttttacgatttaattctgatttaatttaaattttgttataaaaaatccaatccaaccgaacaaactccacattatgatccagaaactcatattttatattttgttaggatgactttttgtctctgatacccatgtacacacatattcattcacattggcgtcctctgctttcgtaattgaactcaaaagcggatacaaattgtgccttaaaagttaaaacaacttcagtatacatttaaaaatgaattctgataaaagataaaacttatattgcttattgtctgtctgatcatgtgtcacaccttaaccagtgtgtagtcaatcatccctccttcctatttgtgtcccatctgcatatccacttcagacccggctttgataatactcgtgccagcagcaatatgattaatttgctcaacaaaaatgcataaaacaaataaagcaactgaaccaaaagtgttggaaccaagcttattgttgcagatcctgtacaagtcttcgcttttatcaccaagaaccatgagtaccacaaggtggtgcaaaccatcaccaatccatatgttcaacctattgtgaatagtacttacgctaatcgttacgtgacagatgcgaacctacaattaacttatttaacagcagacaaatgcacctccttattttaaataaaattgtatagatttatcttgaaattttatattttactctccttatcttatatatttaaacctctaacctgtttttatttgagaataaataatgcatttccttattttaataaaattatatgtatttattttgaaattttatttatatctcttatttttacatgtttaaactcagttttattttttcactacacttatatgtttaatatttatttatttattcatgtatatgatgatgattattattaaatttatttttaaaaattgattgctctcactaggctcaggtcttagattcaccaacaatagttctaatcatcctgatttgaatgatttctctgctggaggttcaacctcatttccgattaatgtccaatcccttgctacccattctactcctacaaatgtgctatattggaacaacctgaccaattagggtgataattaccagggaaggataaaaaaataaaaagactttttgagtcttcaaaataaaacaaaggacttattctctatgctttttacttatgtatttgtgtgcctttaggcaagaagtaataatacaaacaggatttttatgagatttaatcttgtagttttttttaatgatatttttataactcttaactgagggagcttaggtggcctagatgtgactctctttattaaaaattcttcctaactagtttattttgtcattaagttgtggataatctctatagctaatgtgtttgttggtcgtgctcttaaatcgcatttgacactgtaatctcgttgcctccgcttctgcttcatccaaaaagttcaagatatacattaattataattttgaaattaaattaatttgtagttcgaaatttgataaattaatctggtgtaatattttatatttattttaatagtgttgaccatgtaaggggataagcacactgaccaacccacagagatgagatgaatatgtggaagaaaagataaaggtataaaaaagagagaacatgtgacaaatgacatgatgctgaaagaagaaagagatgagaataaatgggggtgaaaaatgagatggaggaggaaattaataaatatatttttataagaaagagacattagaaagactagactataaacttgtattaactggtcaaaatttattgcatcacaataattcttagatggagtttgaattgaccaaaaggaattgaataaagaaaaagaaatgtttaacatacaggagaaaatatgtgacacccacattctattaattacaatttgttagatataatatttttaattaaataactagaaataaaaaatcctttctctcaccctcatccacatcaccattgttagatttcacacaacacatagtatcttttggccacatctgaatcagtagaaaggccattaggaacaactttgatcttgttagcaaatttatggttttggaaatcgcttctccgtcttgttgatccatttaagaacatgatttccctttgggatggaaaggaaaatttcaaatttgtgaaattgggaatggactgggggaacctcacgaagagaagaggggatttgtaaaatttgttggattgggattatattaggtggtgatataatgagaagagagcgcaatgcaaaaaaaataaaaaaaaatagggaaatagagggatgtgtttaactgaagagacgtgaacgagtttgttgataaattttggggagatggttatggggattcaatattgacggaaactattttacatcggttaaaattttatttgattatttttttttacttacttataaaaaaatctactttgcattttttaatattggttcttgtatcaccaacattaaaatgactaagtaaaattcctttcccggggaaggagggatatttgtttaatttccttaaaattaataataaatattttttgaaaatcattatttattaaataattatttataagaagttaaataacagtataaaaaaacaattcaacaatttaatacatttttggatccattccttcctccaatttgtatagtttgagattttgaccaaccaaaattaattaacctaaatacaaggtctgccttaaaaatgatcaagcatattattatatgtaagcctttttttttatataaacaaagtttattgaatgtgaatacaagctagaagtactcaaatcttgcaaaagattttcagcaattacaactaattaaaaggtataatcaaataaacctttgtaccataagatccatccgagccctagtaagcaataacaaactcaccaatatagccaatgtttagaaatctgttggccagcctctgaaagtacgttaaacccaaagtatatatatcaaattaagatccttttgcaaaggtccgatcaagaagctgcaaacagaaacctaaacatgcccatataccttctcaagagagcctcattagaaattgatttccacgtacagaaatgctaaaccagcgaatataaccacacgaaattaaccctagtgtgtattatctagaaagacaacaccatactatcgaataacgtacaagtgatcgacaactcacaaaattaaacctgcttcaataagaacgtaaaaaatagaatagaactagtgcaacttgaattaacgccctcaattatgtcatgcagtgctagttccacggccaattaattttaaattaatctgcataaatttaattaacaagccacgagatttcagtacctgctataacatataagggtaagcaaaatcctcatcttacaatgcagccataactacttgaatttttatcatatgtacctagaatatattagacttaaatagcttgattttgtgcatatagtaaacactcactgatcgaattagttttccatatctctgttcgtcttaatgctgtccttctgcaacattaataatactgttcacttttgcataaaaaatgttaatcatctcaaataaaaaccgtacgtcttatccaatcctacttcgattaccatgtttctttatccccacacttctaaatatgctattttggtatcttaattagatgctattttatataattaacctactgatttacataaggaattcccacgaacccataaatcatgccataaggatggtactatacgctcatttcccacctctttaattttaatattgtggcagactggtaatcaaccaatttggcctatatatagtcgtccccacattatcaagattccacatgtccacccaccttctaaatccattaaccactcccacattcccttcaatctccctaactccagagtatctagaaaccaaaaccttttttttaaccttcattcaaaggcatatacaatgtgagtttaatttttatgtatggttctcatactccatatataattatttgaaaattagttatagtataaatatctttattatattttcacatgactcttaaaaaattccttctgatctttctttttatagtataaatcacttgtatcgtttaaagaaaataataatatttgagtcaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctcaaaaatctgaattctagacatcccacgtgtaaaaacctttttttttttaaagagttggggacatatgaaggagcgaaatgcagaatggtaggtacgtggataatataatgcagtaaaatattacatttacatattttgttttattttacttttggttctacggataatgttgaagaataattttggcactctaatgttttggtagaagaatatatgcgcatgcagacaaaagcagtgtccacagatcagtgtttctacagttgcagtacgtgtcccctcatttatttttggcaattgtcacgaaccaattaatacagtaataaaataataccttaattgtttcagcatcgtacatcaattattgacgttgcagttatggatgctcccaagactgagggattatggattatcttcgtaacgtgatactacattgggtctgcgtctggatatctgctcctgtttgtcttcttttgaataatactatttgagattttttataattatataatagtatgatattattaattaataaaacgaatattcaattttggaatttgagttaattagttaattaattttataaagagtttagttaaatttctactacatttatttttgtttaggtatatgtatgtagaacattttttgctcaattaatacaaaactcaattttgtatatctaatttttatatccttatgcacaagattcattgtatttctatataatatgcagggtgtcagactggtactatatatcttttcaagagtttccttttcatatatgttttttcagatatctttgcacggctgctaaacaattaagaacattataattatatatataaattttaaagtaattaattattgttataaaagtaaaaaaaatattatcatttacaataatcaaagattaaagtataatataatttttttacaatttaattaaaatatttaattacatctttttaaatcaatttaattaaataaaataatgtgattttttggtatttgaagggaagtatatataacattgcttagaatgttcaaatatagattttcatagttctatatataatatggtctcgcaaatcaactggccgagcaagattgaagagtatcgaccacatttggactttgaattttgtcaataacgtttttcagatttaaataagtttttatcctcgtcaagtatagtttttttattttagtttatgaagtttttttttcctattaatccatacaattattttaaaatcttaatccttgttattatcagataacaatgtgataacgtaaaaataatattgacatataattgaaatgtcttgaaatgtcaccttaccaaaaaaatttgacgatatgtaatttttttaactatacttttaattactaattaatttatctgacattatcaattattactattttgaacacataagaattttttttattattatattataacttataagtgtgaaatattcacccattttctcagtaattaattaatatttgttgaaaaatatctattattttaatagattctctcttttaattatatttgcaaatttttaattcacaatttaatttaaaaaattaaatgcgagtttagtatcaatgaaactaacataatgcagatattgtttttttacaaatataatgttgatatttaaaacggtatgtttcaattttcaagacctctcctaagtcctaagcatgtcaagcagtgaaatttctccttttagatttggttagttgaactgtatgtgccctaagccctaactcattcagacccacagagataatagatttgttaacatgaggctcttctgtcgccacgcgttccatcatttcagtctctaatgaattttcctcttcgcacacatcccacaccacgcgcgtgtgaccgttgttttgtcttcttgtcttgccctaattgtacacgtaaaaataatggagaagcacaccacgacacctcttaaacatggatacattttatttttgggcaatagatgtttttgcaccttctttccccaacaccatcatgaccggtggtttctcagtatacacaacgtgttcttgcatgtgcactgggtttggataactgccatatttcacaataatctcccattttgcaaattgctagtgtctatatatatttccattatttgagcaaatgttacaaagaaataagttagaaggagtatgtccttatttaaattattatttgttgaagtttccaaataaaatacaaacgcgcaggcatatataatgcttgaatgtgctcaccactcctctttatgattgtatatcaaaatctaggagctccataggcgccttttgagcatttttaaatggaaaatgctgaatatatatggtagttgtgggtggtttaattaatttctcttttaacttggttctctggagaaagttttggattgactgtgacttgatacttactattcaaacttttaagtcggtaaaagtgatattttgaagacttaaaaattaatagatgaataaattatataaatcttattcattccatatttttttatatctcatattttcacgtggtattatcattaatgatttggtttggtgagactctatttcttattttatccagaaagaattatttagaaataaatataatatgtctttgttataggttcaaatgattatacatgaattttgattttggtttcccacaattctttattttctttttggaatataatacagagaaatgtgttgttttggttattgatccatgatcgtaatgtcaatctagttggaattatattctttaatatgctctagtacatctcctgattttgattaaataaataaatttggagtgtacgagtagacaaaagagggacaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaagttagttgatatcatttaattttactaatcttaaataaaaaataagattatcgatatctttattgaaacttgatattatgaataaaaaataatctttgaaaattgaattgtaaatgatatttaaaaaatatataaccaattagagtgaatttagtttgatttgcttattttgagttccacctacaaagtgacttttttgcttatatttaattccagaggaagtacaaaatatgcgaccattatcactcttagaataatgcaaaacaaattactcatcaatgccttttgattaagagaatacaggacacgccatcaatgtccctacatcctacattcctaccttgatttcagtactttaaaatttctcttctaagtgcatgtttggattttagttcaaaatgcagtatacaaatcccaaaataaatctgatggtttgcaaacttaattttattaaaagaagagtctggatgcttttacaaacttcattttgcaccaaacgtctgtttgcaactaaaaaacaaacatatactacatcttccttttcttcaatctctcattttttgcactatttttttcaacttaagaaataaaagacatttgtttgatgaattcatcgaaaccccccaaatgttcatgattgttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgattaataataactaacacattttatttaatcaattgagttaaattgtttgataaatattgataaccgtgaacaactttaacaatttacttgaattcaaaacgttaaattaacaatctaattgcccctacgtgttttaaacctgttaactatatagcagtacatctctataatagacaactcctacgtgtttatcaattattaaggacatctacgagaaatttatttgatcttatgaaaataagatgtgactctcatgagtaatgagttatcttttaaactaattttaacaagttttatgacatcaacccttatacaataagagtttattgaattaatatataattatttatttatctcattatatcgatctgaatagaatgttccgtgagaagcactaaaaaaaaactatattaacagtggtagtggacacaaccaatttaggcaatgtctatacaagaagcaatatatagtaaaattaaaatcttaattatgcaattttttataatatattatttttaaatattaatgataatttaacatgtgtattattgaaattatctagatataaaaattaattaaaaagtcttctatgaacatgaacattataaaataatatacagcattactccttttgatcatttgaattttgaactaaatcagatgtttcctacacatgttaattctacttacaaactatcaacacgtacggttcgtatatatatatagaaagtttggtaatttcaaccatatgccttctattctccaacatgcagaattagggtgggttgacaaccttacttacctgcaagttagattttgcatgaccccgatgtttgggacttattcacttgtgctccacatcctcctctaccagctgcatcatgtttttaggagtattcccactaatagcatgaccaggtagcttgtggcccacgtttgccctaacctctgaccatgaccactaccacttgcatctaagggtgatcatgaattcatatgatgccaggtgatgagtattttttttcttctcttacttcaactaaaattatgataggatcatttatttgaatttgttcaaaactcttgataatatataacacagaattaggtaattaaacttaatttataaacatagttggcgaaaacaaattagaatagaagatcttatgcaaattacctctcaccaatagttgaatcctaattaatgattctagtatatcaattttaacattgtgaaaagatttttttatcttaatcctccaattcattgagaaaacaagactttaactaatcaagaattcgactaaaagatcaataaagtttccgtcaataatcaaacttagatattacttagaaagatttaatattaacttcaacacattgatcatttatattcaatcatatttgatttaacattgtgtaaaactaaatcatacaataaaaaatgtatatataaaacttaaactaaggcttaatatatatttgaaaataaataaaatgattataaatattatagtattatattatgtaaaatactacagtaccttttatttgctatacataattattaaaaaaaaattatatatactctttaaagaatataaaacattgaattggacagggacaacccaattcaccctcaaattacatcggatgtaatttctaaaatttgatctgtcaaaaatcgacaaatcagatattgatagaacggaatatacccctagttgcatgtaccttattccaaacattcctataagtactcttgattggttactcaattacatttactgaagcttaattatttgggcgttgtgtctatataaatacatttctatcgttgttccatcgctctccatcgcgatccactccgtcattgcacgatgggtttcttccatattaccaacatgtagggtttcaccaagttaattagaataatttagcattttcaaattaaattttgtctaaccttgccagtaagggataacttaattggtaggattgaacaatcgtatgcgattgacaaaaatgggttcaattcttaataatagttctagctattaaaacattttgtgaaggaaattgagatgggaagagtttgcattctcataaacaatattttcaggaatattacgactagttaggtaaaatatataagtgtttttagaatttaaaacttctagaaatatttttcaaagtttaaaggaccagagaaaaaagtgagagtgagaagagaagttaatagttcagatatgaatatttttgtcattgttattcaaaataagattgcctttcacaaaaattatatgatttgtaaaataaaaatgtcaagttgttttattcaaatacttaacttctctcgatatcttctctaaaaaaaggaattaacttctcgatcttgcatgtcaatagaagagaagttgagttttggaatataataattaacctgaaatttcttttatacaaaaaaaatccatatccacatacatatgggataaaagagatgaataaggataaaagaatagaaacataatactgacacggggttattcttctctttcaacttctcatttatctcgtatatatgcatgtgagtatgaatacttatacttgtaccattcttactcaatttatctctcttttattatcatttttctctaattttgtttaccttttatacatacccccataaaataaagtgcaactttaatatttcacaaaattctcagttcttttgtagaaggtaacatgaaaatcaaatcatgaacccgtagtccgtagagattggcacttggcaagttgtctttcttggaaactagctttcttttgtatttttatcccttgtagctttgtactggtacaccctaaattaagtttatcacgagtaagagagatatgaacatcttcaaacccacttaattataaattaataatgacagttgttaatctaatatttttttacttatgagaatcaaagcaaaccgaaccaaataaccaaataaccacagtttgtttgtcatccccataaaatcccaatcacattaacatttattgtcacactcactctctccttccctcttagactcattggtagtacgaactagaagtaaccatgtccggtcatcgacgccaaccctcccaagcctttccgccggacctcttcgccgccgacgacctcactaagccctttgacttcacacaaatcatcaccgaagaaaccggaaccgccgccgctgcccaagcctcacgcattcagacccaccaagagatcaaagactctcctctcaccgccacttctccggcgaagagcaaggcgccgccggcaaccaaatcggcttgaaccaccgtatgcaccatgagtctgctcctgcctcctgctgctgcattttatgtctgtcattttctgtttttctgtttttcttttcttctttcttttctttttgtttgaaataaaattgttaagatgacagcagagaaaagctcaaggcattgtaacatggttttcttcttcttcttcttctgtgtttgagaaacttcctttttgttagagcttggaatgtgaggctttgttgtgatttgctgaccctgcctctttctatttgaagtttctatcaagatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaaataataaataagattataagaatgtgggatatgaatatgcacttttatcatacattgtgtttgtgtttggtagactttattatacatttttttatggatatattatatatcttattgtgggtttgaatatgatttaaaattttatttattgttcataattactaagcaagctaaatatttattaattacaaaaaaataagcaaaaaccaggcatcatattgtaatttgaggtcactaaattaaaaaggacattactcttaacctcataaagttatatgtcacaatttattgatcgaaatgacaattacttttgttttatttaaaaatctattattttaattatttatttacttcagcaaccaaagaatttcagtcgctatataaccactgatgtagcaactaaagtgtattctacaatcacttcaaaaatttgtaatatgaaacaaaattaagttactgaattagagacaggggtcataccgaccgaaatagccactttcttaattaaaaaaaattagtgagtaaattagagatatagattactgtcgctgagttagccctttgccaagaaaagtgaccaaacaacatacgaatgagtagtttaaattagcaactgtttaaagttattattgatttttgggacatatttttcagtctctaattccgtcgctagtatgtagttttttaaatgttagagactgattccttggtcacattttctttttgggacatttttttatttttaagggtttgattggataaatttctttataaatacatacaaaaagataataagaaaaaaaaaacttctttaaaagctaaaattaacttatgcgtaaactaatttataaaagttctttcatattaacttctccaaaagttgattctcaacttatgcataagatctgaagaaactaagacatatttagataagcttatcctaaagcaattatagaaaaaaaaaagaaataaacttctccataaagtcaaattaacttatgcatgttctaattactcatcttttagaaaacttatacgagagagagcttttacaaattaattttagtctctaagctaattttaacttattttttctcataaatatgtttatagataagcttactcaaacataccattatgttatttttctttcttattttcttctcttataagtgtttatggataactttatcttaattttaaaacaaaaacaaagaggcaaatgcaacaatttgggagttgaaaaagtcttgatccaacttagtcattcaaatctttattttttgaataattaattagtattcgtaatattattattttttataaatataatataatattgttaaaatattttgatcgttgttttcaatcaaaatattatttattaattcttttgcaacaaggatgtaggtgtcaacatagttgagatgtatatcctcattgttatgcatcaacactccattttgaagaagaaaaatcctttgtcattaccttaacgttaattattaattaaaacattttttttttgtaatttcaagtattaaaacaagtattatttttaacgttagctacaaaaataataatgagcatttagtagcttttgacataaaaataatatttcttcgattttaagacttaggttaattaatactcgtcatttaagagattaatttaatgtatcactggaacttttcaaacagagcagaaataacgacaacaagctctaacatgaaaactgattcgagaacaagattaacaaacacatcgacactggaaactgtacacaacataatggcaaaataaactagctagagaaagcctttagcaaagagacacccaccattgccaccaaaactccgccgattaagaactctaaaagcttcatgtaaaaaaattagggaactacaagattgaatcctatagaaaatatgtttaattattactccttgcgtgaaggcacacggatacataggtaaaagcatataaacgataagtttgtttttgtattattcaaaacacataaagtcgcaaatgaagctttctgatccctccttatcagttgtcaccttgattggtggggttgttccaatagagcatgttcaaatctgtaggagaagtagggggttgggcattcatttgagacgaggttgaagctccaacagtgttgttggtgatgccataattgatagcattactcataatagaagcataacggttagcatgagtactatttataataggttgaacatttggatttgtgatgggataccccacctcttgtactcatgctccttgaggagtgaagccatgacataaggtgtgtttgaatacaagtcaaaaatacttttgagagtttttctaaaaaaaatataatatttttttcaataaaaaagttctcaaaaacatttctagtctagtattcaaatagattcatacacatgttcttccgcagcaataagcttgcctctaataaggccagcaaagtgttgaggtgttgttcccttcgagagttgaatgtttaagaaggagatgggaatgttcttgggaggtaaaggtgaaaggctttttggtgcaaaatccctttaggcctcttagcaataccaattggttcatgaggaggaacatatgactcagtggataaccgataggtgacaacaaagttgatgatagaggtgatgatggtggtgggaaagggagggttgtttcacaaagaggaagaaagtaattcagagattgggggcacaatatgcaggacgtggtgtgaaccttttgtatcttttatgacaatttatagagcagtttcaaagattggatgatgtggggatccactaattagattttcatttagatacacatttatctatttttaagttttttttcttctaagagtatctcacaattttatgaaactaatttgttgaataattaaatcattaaaggattattttttgtagcaatttttttgaacaattaatatagtgttgttttagattttttaggggacaaattcacaaatatatatattttttgtttaaatatatttttgttccatgataaatttatgaattttgtatttggcctttaataaaagaaattcttgaattttgatcgctgaaaagttcaggaattttatatttagtcattgccattaattacattttctttattaagtgttacatgtttcattagttttcttttgtctctgattttttttaccacaattgtgggtatttttccatcaaatgacgacatttaattaaaaatattatatattttttttttttgaccagcattaaaaatattatatataacaatttgtaataattaactgagacttggtgccatgtttttctgcttagtatgttaaacgttaaaggtggttgagggtgacggggttggggcgatagagggtattttattttccaattttaagctttcaatcccatgcattatattaaaaatattatatctatcagtctgtaataaattttcttgatcatttaaaacaactattattttgtaacgttagctactaaaaatattgctcatttagtaactttggacataaaaaaatatttttaaaacttcaagacttaattaaattaattaatactcgtggtttaaaagattattttaatgtattactggaactattcggtcaaagaacaaagagaacagaattgtagcacggaatttgatttgagaataagactcacaaacacatgcactagaaactatgctcatcataacaacaaaataaactagttgaagaaatccttcagcaaagtgaaacccaccatgggcacacaggcccccttagttaaaactctacaaacttcatgcaatttttttttatacgattaaatctcagagaaaatatgtttgtataatttctccttgcttaaagacacgaaaatacatagataaaaaagcatatacaaaaactctattattgtattattcaacaggttttaactcactcacacactttttgattttttttttttattataggactgacgggacttccctatttttttatatagtaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgattacaatcatagaaaacatttttgttaaagaagcaactaatttaatgagtagttattcaaaataacttctgattttaattccattttagatttttttttcaacttctgatcgttttgaaaagctgaagcaaatacacacaaaaaaaaaacttttaaaactgatatatatatatatatatatatatataaaagaacgaaaaatactgtaacaaacagacccataaattttgcaattcattaataaatgaatcattattttatatgttatgtgaattataaacatgttttattttaaactgcaggctaaatgagccaacttgtatatgagttgaaaatgggttggttctcatcgagctcaagccctcatcagctatcagttaaaatggacggttcgcatatcataacccgtttacccacctccaatcaccacatgtttacatgtgactttggtattagtattaatggataatataaaaagataaaattttctgtacaatacatggaagatcacctttttcttactgaaggaagataatttttgttatttcttttaactaaaaatatctttttaagttgcatttatattagaagtgtaaaaaaatcaaaattttataaaacttcatagaagaagataaagtatatgtaccagttgaaactatttgattaaatttgaaaaaaaaaaatcagcaagctcacatcaaagatcaaactaacccaaagatcaagttggtatactttggcctatcaaattgatgacctattaatatattaaaatctcaatttaaggtttaggatatagagtttagaatcattcataaagaaaaataatatggtaaaaatatataaaaaatccttaaatttataatattaattaaaaatatatttgtctaggggattttttaataaaattatatatatatatatatatactagttagagtttagttggtttaattttaaaaaatacgaatttgtgtgtgaaaaataaagcaatttaagtagtcaatgtttggtttaaaattacaaaaatactttttcaaattttaatataaaattgtgttctaatgtatgaatcgagaaatatttttttttattgacagatattagtaattaataagttatagtaaaaagatttaaacatataatttatttattactctaatttttatgtactttctcaattatcaaaccaccttataactctgctaattttaaaaaatattatttttagagtaaaagtacttttaagctcctaattttaattgagttaaccaaatctagtaaacacatctaatgtataaaataaaataaaatgtatataatattaatattcaaataataaatatcaaaatatgagaaatttcttatccaaggcaagcataattgggcgaacattgtcccatcccattcccatgtcagaaacatgacctttagtcttcacttgataatcacaatagccaataggctttcctatattacaaagcaaacttctgaaaaatggtcctaattaagaggacaaaatgtattaataaagcaaccaattcatagtcaatatcaacaacttcgtatgggcccagttccgaagccaataataggctttgtttgcttgatctaacaaaattgacgcgtgtcgtattttcgtcctttgcacataaaaacatgaatatgctttttcttccttaagcaacactactacagtaaccattatctcaacaacaacaacaacaacaaaaaatgtacaatttctttagctgaaaacaaattatgtatgattgatgatgtgcctacgtttgattattatttcttacctaaacctcactaattattttccacttaaattcagatgcagtaacgttgacaattgtgacagatgttttgcaattttgattgtgcaaaaagcaataacgagaacaatttggacgtggattttggattccacatactagatttcgttgtctcctctgaactgttttcacgatgagctccatattgtgttgacaaaattggtgaatctgccccaccatccaccagaataacaatagtcaacaaaatttggctcggatttcttagcctttgatcatgacattagtttttaatggaaaacgtatatcgcatattgaagtagaatggtgaatatagtttaaactctcagtcctctgaagtattaacactgtgccttcttgcaatttaattagccacacaagtaatataactactgctatcagaaattgcacaaaatggattaatctcataaacaattttttttaattaatcatttgatccttacactttgtctcatctttttatttagattttatatctaaaaattctctgttttagtctatttattcatgcaattttttttatgttttagtagttgtcgattttctagcaatataaaactgccacagagtagaaatataagaattaaaacataaaataattgttcatatgaaaactaaaacagagaatttataaatgtaagaataaaacccatatcctcttctaccggctcaacattgttaattgagtcacattaggttctaaaagaatagcttttactctgcatatatctaatcctctttacaagagttgccattttttagtacataaacatgctttaaaagtcactgattttaatggtatagtaattgacaaaaaccttgccatgattacactatagaaaactgatgcatactcatgaagcattttttgggttgcacagccatgagttaagcaataaacaagacatctaaaacagaagattattttcatcacctaaagtgcaggtcaaacaaaccaggactaactaaaatctttaataaatatcactgaggaaattgaggtaggtacctgatgctataataattaaattctcacaatctcatatgcttgctattttcaacaccaagaggggtgatcagaagaatgctctactaccataaaacacacgtgatccatcctttttcttcttatcaatttctaatttgctgctgtcatgattctgaatcacatcaccatcaccatgatccactttttcaggtttgtcaaggtccattgggagcttcatttttgccaaggactcagtgaactgctgcatgctcctcatatacatgtccactatttgtttttgcatagcagcttgctcagcttctaaattgatgttccctagtggagctgaaaaaacttgaccaaactttgcagcttctgtgttgttgttattgttttttttgctttccttttccttgcttgagaagtttgcatctttgtcatttctggcatcaccttcttctttcttggaagttggggtatctggaccagcaccacagttttgactaccttccacagttattgacacagtgacagaatttgatgagtcaccagtgctcaaatggttctttttctcaactgaatcagctgagtttctatcatcactcaaggttgtgatggtggagcctaggaagcaagagttctgaatgctctcatttggagaaatggaccctacatgattctcatcttgtgaactcatagtcatctcataatcatcaagttgaggagatgcaccaaggtgaagaaatggtagtgaccctccaatgttggaccttgaaggagcagaagtagtaccttgagaagccaaattgaagtactcagataccatttgctgattctccttcaccacactgatgtcaggaaactcaattctagcatactcaactgggtccaacataacttttgaggtctttctatcaagcaaaataacttctgatgatattgatgagttctttgctgattcagttatcaaattcactgatgagttgatcgccaaagaggggtccaaagacagtgttagttggacagttcctgcaggagagtggaaaagatcagtggaggaaaggctgtaatcttcagtcacctttccttttccaacaacttgtgaaattgggaccaaagcaaaccccaaaagctggtcttccatgtgaatccttgacctactaaacatccaaacttcacatttcagaacagcatctatttgggtgatcttcatcctcaagttttcattgaatgttgggtttttgccacctccattgatgattcttgtagagagagtctcatcagggttgtaagtgagagagaacttagcatacacatcctggttgtcatagatgcatatgttatgaatattcctggcatgatggacaaagatatcaagaatccctgagaactcagcttcttcatctgcatgtgtccttgtgttcaaatttggattgtacctgaagctggaattctgaacactctgattgaatgaatccattccaagttccaacctttgttatgccttggaattttgctttgcaaccagccagaaggtttccaaaattaggaaacgcgagagaaaaagagttggtgttgatatttggatcatcaatgatcaccttttggatacatagaagaccaaaacaaaaaaaaaacttgattatagaacaagctagaaatcagtggaaagtagaaaaaaaaaaagtatctaaaggattaaacagcaaaagaagagggttttctcacctagtagaatgaatggtaacaaaaagttaaataacactagctctctatgtatgttggggtgagtatcttgtagttgaagacatttgtcaaatcaatccatgaattcaggaacaagcatggataaagatagagagaaacttggagttcaatgaagtggattgctttatggaatggaagtggggtttaaggaccttgtggtagtaggtgaaaaatgaagcatggaaatgaacagagaagagtattatgatgtacatgtttgtttggatgccacttttggtgttgggtttctttgcttcacaatgcagcttccatatatctctattctctatctagtgcatagcttgctccactgatgacactaatgctattggaggacccacttgccaccatcttcattatcactctccccgctcttcaattgatgctaccctcagctttcagacaacataaattgccttgtctctcaagggctattgcaacaaaaacaattcatctcctattggaatccgttcaggtcaaatcatggaaatattgagttaccaagataacaaaaaatcttggttttagtttaacattctaaaatacactttataatatttatatatatcatgcgacaaaataccaccattaaacccaactaatgaaagtaagtgatttccccgtattttgtatgctttttttgaagggttagatctttcttattttaacgacgtattttcaacataaaactgtgaaaataactagtcctgttaaatttctcctaactaacctatctaatttaattaaatattataatttaaaacttcggtgagttaaaaagaaaacaaaaaatgttgtgctttaatatcttcctgccttctgttgactgacttcttatgtttaaatatgtgaatagctaataaatggaagtaatttctttttaactcggatattttcagtcgagaactaaaaactaatcaattgtttaatggaagtagtttagctaacaagaaattaactattttgttttaaaaaccataaattccattctcaactactagtacgtaattccccttagaaagttttcatgtcctaactttgataaggaagctttctccacaataaactttttgtagttaaatttaaggaaagtgagcaagacaacgagttgttggaaattcattccactttgttaatttgaatgattatgcaaaaagtttacgttggaagtcttggattcaagtccgcaacatgtggtatatatgagcaatgagggtaacaccagaaatcataacctttgactgctaatttgcctgtttcttttccctacatggagccatattggtaatagcctctctctctctcgcacacacacacaaacacgaaacactacaagctcaaaaagttaccgattaaaaaagaaagagagaaacacgaaatttagtgggaaaaaacttcacatagtgtcaaattgttcccacaccccatgcatagcaagataagacgtcatgatatagacttccccataatttgttaattgtgttatttccttcttccatttcgtagtggatcacaactggtatcactttagtccttcctaactacgttgtaagttataagccacaacctaacaacatcccctctcttagacttttggtcctcagtgccctaccaaaattgcaatttgcaattaatctactagcaataattttagttattctctatttatatatatatatatatatatatatatatatatttacgactattatgggaacatttttccatagtttgcaataagaagttttctcaagaatggcaaagtttaaaaataaaataaggaaccaaaaacaaaaaataaaatagtcctgcatttttcgataacaaatcagaattgaaaaataaagtaattagctgtattgaaagcattcattttgacaaaggggatatatcattttgatatattcatatcaaatcacttaattaattctgtttaaaaaatcatttaataaattaaaaaaattgtactcaattatattgtttgatgaatgttatgcaaatcttaattagatagagaataaatataatttatatttaatagaaattaattacttaaatttattaaacaataatggatgttttcttagcatttctcgtttttataatctaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttcatcttatctttattattgtttaaatcctaattttaaattatttatcatatattcattatataatattacgctttcatcattattatataatattttgtattttccttcatgtgacaccttttcaaggtacattcatcactaacttcatacattatacactttaattataaaacaaagcttttgaggatggtttcttttctttcattcattttttaatttaagtctacgtcaatgattcaatgccacacagagttaatgatgaaagtaccttgaaaaacattgtcaaattatggaaaaataaaaatattgtataataatgatgaaacgcaatattatacaatgaatatatggtgaagatagtttaaaattatgtttaaagaaaaataaagataagatgaaaataaaattttatataggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggtatatgtaattctagaaatacattactagaaagtaaaagatgggtgtacttagtaaaaggatgtgtaaatagtaagtgccttctttttaggccataagggctatcggtacttgtgaatggctcgtttaacagctccttatccgtggggcaaggatgtaactacataactctaaaaaaaactatatataggtagagtaaaaatatatgatattattcttattgaattagaaaaaatttcagtgcgttatagttttgtttttatggtaaaattttaaacacggtcaataattatttatttaaaaatcttaaagttttgggtcgaaatctatatcaaaataactaaaaaaaatataaaaatccttgtgaatgtttttatcattttaggtatataacctactttcactgaattggaaaagttaataaaaatatgcaccagctcggctccaagaccagtattacattgtttgtaagaaggaacgactggaaccggatccctgcagttaatttttgaactgcatggcgcagttataaatctaaagttgaagtttttaaattgttttatcatttatttcaacataaaaataaatggataaaatatacttatagtctctataaatataatttaatttaatttagttcttagaaatgttgctaattttagccttcataaattttattttatttttaaatcaattgccatcattatttactaatgatgtaaaatacatttagacatatcatgttacatatcacccccggaataattagttatataatacagctagatgtatacgtactacatcaccactttgtaatgacatgggctatttttttataaaaaaaattacgagaactaaaattaataagataatttttagacacaaaaattaatcatatcaataagcacataaacattttcaagcaaaaaagtaattgcaagtagatgaaaatactacagttattttataattgcaaatgattgttacttggaaatgtacctagctagccaacacattttaggagttatacttctttctctttctcaacacgtttgctatcttcttttcttttagcatgaacacaaatgaccaagtgtgtgtttaatttagcatctcaaattcacatttgcaggtaaatttatgtttaaattgtattaataacgtagaactaattattatttgtgttgaaattgacatgcgttttctatcgctcatccaaacacacggtaaaacaaatatcattattttaaaaaaatgaaataataattggggaaaactttttaatactctaaaagattagtatgccatggtagttaggcctactagcaaagaatttgggattttgtacgaaatcactatcacagtgagtgaagcaacttttaatggtgtgcaattaattagaaagtcaatcagtaaactagcatgacaaaaagaaacttttagaatgattctaatcaaagcatggaatttgatttaaaagtgtgagtagcacttattggtgcacatttaaaccaaaagttaattttggttctcaacgattaaggcacaaagccgatttagaaagcaattcaagatgctcaaagggccctcttttgaaagctctccgcaatatcttgttattgtattcagtaaaagctttcttgaagccagaaaaccaaccgtttaaataatgttcgatgcacaaatagtaatgtgcatttagaatgtctgtataaaaaattcttacttaattatcaagactttcccaaatacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatgtggaaaatcaaattgatgccaaatttattttggcggtaaaccaaattagagaaatatatctatctatttaagtaaactagatttgaagaaaaaaaaacactataattttaaagaaatattaatgtaatacttaatgctattaatgtaaattttataaagatatgtaaataaatattttttttcttatatagtatttaataggttaaattaatcttttttcactgcaggttaaattaatatgtaaatctctaaatttgaaattttttaatttgatctataagattagcatcaacaaaactaaaaagagttatgctcaatggtaatagaaattgttattaagcatttaggattaactaatatattttacaaagaattgttaaaacttaatttccactaccaaacgcctccttcttaaagtgatctattaacttgttaataaggtatttaaaaacaattctacctagtactttattgaaaaagactatattagcttatattctaccaaaatttaatcactatagtctaaaatctttaaatatttttccatcccttcagatttcttaatattattagaatgatggttttttattcccttttctctgctcggctccaaatatttaaaattttaaacttctcttctcatttctattcccctacaatcaaatgttatgtttcttttttatttgttttttctgtaatcaaactaagaggaagaaataaaacaagctcgatatgatcacttgttgggctaaacccatacatacacctacaagaactcttataactttaggacgaacattttatttggatcttactatttacaccccgtactcccctttctatctcttgattatccattataccctttttcttaaagaagtacacctcttttacattttagaaatgtctttctagaattacatatacatatttcagaaatgtatctctagaactatgattcatagtttcagagatatacttttagaataagtatatattttttttaataaaataccacttaaaaattaagatgattgacgaaaaattaaaaataatgataaacgcttattttatactcatgttcgttggtcttattttcattctatcattaatgttctttaaatcttattttcatcttatctttattattgtttaaatcctaattttaaattatttatcatatattcattatataatattacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacaaattttgacaaggcccgatacattcagtatttatatataaaaaagaggatatgaacaatttttaacagtacaaaattatgtaaaaattgagagaatattcaattccattacactacacccagtcacccactacccaatgtgggtaaaaagcttggcatggtcagagaattaaaacttaggagagagatggagaaaaacatagaggcatatgaagggttaaaaaaaatagagatctaaatttagaattatattattcatattctacttattataatattatattattcatacctttgcaatttttaatctgaccccaaatcctgttcacatctccaatcttgagacaaaaactcaatcaaccagaaaagggaggtttcaaatgggattttagccagatgcgtttataccttgagtggttttcatacgagcattgtttaatttatacgcttcatcatatgctggagagaccaaactcaaccaacaagttaaaaaggaggcttcaaatgtatgattattcttcgcatccctagtttatagaccaaaaaggaaacaacatggctggcccttaagaaaaaactaggttgtgcctccacttatgaagctaaaaaaataaaaaataaaaaatcctagaagaatgtcctcacaatctataagctcttttgaggaaagataggaagaaacatgtgattagttctgttaataatttgttttaagagataaaactatccgaaggttatactcgttttttttactgcaagtataaaatcataatagtacatcaacacccttatttatccacctgaattttgttaatacaaatttgagaacttgatgtgttgtgtaatgattcagtttttattgaatacaatattaaagaattttcaatcactcataaattatgttttaactaattgagttagatcttttttattatgtaaaagtttggttaaacgcatttttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgacaaattttgtcaaacacggtcgattctgccattctagataaattcataaaggaactgttccatacaatcacccaagaaactcataaagttcaattcaaaataagtgtgcctggaataattaaacggacacaagcatcctgaacgtatacggcacaaaaagtaaaaataacacgatgaaataaacgattctcaaataataaatattataaacctagattgtggaatcaagtaatcaactaagcactgaacaatcctttactatatgagcacaaaagaaaaattccacacattccaatcacttcattaccacccttatatatggactaaaaaaatacaacacgcacactagtcagaataatgacacgtttccttaaaaaatacatggtgaagaatatgattgtagctgttaaataatcgcatactaaaaacccagggaatgggagaaaaccaagtaacagaaatgactttacacaaactcctatataaacaatcgtagaaatcactagacatttggaacaaataatacgagcttaagtcagactatggcagagccataatttgatggaaaaataattcactgccacaagcattgtgagatcacaatacaaaacaaaagcaacaaaatttcggaactgcaaagagcatgtcaagaaattaaactgacaaaaaagcacaaatagggcaaaacatgaaaacccagtatcaaaaatgcatatcaacatgtgtaacagagacagtgaagaaaattcaagacaaaatgcataaccatgtgcttaaattttttaaatggaaataaaagtctcagaacatgacaaaattaagacatgataatggatcacaggcagcaacaaagcaaaagggggcacaacaaaattgttcgcagaacatgactaaaagcagacgcataaaactctagtgtacttaaatgtgagcaattcaagagtagtgtcctcaccagcacagacatgtaccttaatgttccaacataattacaccaaccatgtgaagctgtatcaaataatagtttctaccaaaaaatacccaaagataaagggaggccccccacgcaaagaaagaaaaactagttacccaatcattcacaatggagaagaaaacaaatgatagtgctaacatatttttacatatgctcccaaatcccagaaaggaaaaacaatttgccagcacaagacaagctaaaactacccactggtatcaacattctaaatgcctgctctagggcacaaacaaattgttccaaacacaacccttaaatgaaattaactaaagacagggtaattaattctacatcagtggaaaagtaaagtaaatgattgcttttttattgacatgataggaagagttagacagatcagcattatgattcaagaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaccactggtacaaaaatgtgaatgcattgtccatattagtctattaatgaactatcatagcatgccacaacacaagcaatcctatgcttcatggatatttcatgagtgaaatatgtagcaccatagcaaacacaagacaaacaagatatatatataaaaactgtattgcaatccacatgacataatcgtcctaaatataaaatatattcagacaactaaaagggggcagcatgtgcaggaaaagataatctaaatatgcaatgaatagagacaatcattcatttgtttatcaatggtcggaaaccgtatctaagaatctagccaaaaaaataagtgacacatctgcatcttctccggcaatacagtatataaaagctgagaatgcaacctcgacatcaacttatcctgataagaaaaaataacatacaaggcaagttctaggatatccgcatgctatagaataatattacaaatactactattaaaatcttttagaagagaaaggaatggctttttaaatctaaaatgggtctagattgcaaatgaaataaatgtgacaccaactcaagctgcacatattggtatttgaagtttagcaccatagtgcaccaaaattgagcaacagaagaattaaacagctttaattttggctagagacactggaaaaccgactgttattgttagaagatgaaaggttcggtaattgttattgcctgaactacaaatcccaaacaaagaacaaaaggaaataggagttacattaagtcttcatgaatgcagaaactttgcaggtttctcacgcatcagagatgaccaataaactaggatgaaaaggacagacatacattgacggtgacgttacaacaacttctaatgctcaagtctaacacagcagctacttgtaaaatcaacatttatttattccacaatatttaaaacaaactgagccatcacaaagtggcaatttaatattagcatctagaactaaggaattaaataatgtattatgtttatgtctattcagaaaaatcgaagcactccaaaataacgagtaaataatgctgaaaaatacatctggaacgcaaaggggtgaaggcacatcaataacaattatcagaagatattaacacatataaactcatctttatcatacgctttatactgtagcaattgattgtgggtataatactgtagatttcacctttggcaaatttaagtataaaacaatgaaaataaagggtgagtaaaatggaaaacaaaaggcatttgcttcaaaagaaaagttgatataattgttgcaagcttgcaatcaataatgttaactaaaaataaaatttaaaatagtgaaccaagtaaaataagttttaatcatctttgctttccagtttgagttaaatttagtacataagaaacaatttcttttaacagttagaagatagtgaggcttcctagtcactaactgatgatctcatgcaatgacaagggccagattgggcgagagaaagaattatagaactaaaatcaagttgaaaaatggcagacagaaaaacagtgacatatgcaataaaggtacaaagcctagaagaaaattaaaatatcatcagcctctccaagcccatctactaatatcttgcactcggaaagacacagtttttcagacactttcagatcaattcattggattaccatatgctgaagaaccccctagtaaccctccaccagaagctgcataaacatcattaggatccaccattggagacgaagatgaaaccccatttcttcctgcaccaccacttccaccattttcaccacccaaatgcaactcagataggttaggatacacatccctattctccactccttgatcatagagaaaccctttgaacacgtggccaccaatcttcaccacagcttgatatgcatactcatcttgcccatcctccactgccgtcactcttacacacttgaaaaccgctggtgcacgtacttgcccaggtaatgactctttgaaccccgcatctaatgcacacaattcaacaatacacatcacaattaaacaaccttaaaaaccctttcaactctcaaacccatgcctatgcaccaacccaaaagaagctaatgcatgagttttttttttttccgagagaatcgaagacagtctcagaggtttacaataactcatgcatcacgcaccctgctcaacggcagacccccttgacgctaatgcatgagtttatgttaatatatgtgtattcatgcaaaataaaatcatttcattattatgaaaagaaagcacaaaccttgatggctagagctagtgtcaaagcttctaggaggggtggtgttggaagtggaagtgtgggaggttgttgtggtttgtgaagcaatgagcctaggttttttagtgccggaagtggagccactggagccggcgacagccgcggtggccgacgtcattagctggcgctctctccggcgtgcggcggggacccaagtgctcttaacgtgggtagggcaatcaaagcctcggcttttgcaacaggttctgcaccttctattggtacaatctttctttgcctgatttccacaatcttggcacgttgttccgccgctactagttccagaagcagttacctcgccactgttctgaaccaaattccccgaactggtgttactattatggtctagaagaccctgctgcagctgcttcttcatgtagtggctttgatggtgttgttgttggtcttgccatagctgaattcccccaccgccacgtgtcctatttccgaggatgttgttgttgtcggattccaggcacggcgtggcggcgaggagagggatgacaccgacgccgagtgcagtggcggggttgagggaatccgccatgacggccggatcgtgttgcggcggttggtggtggtggtggtggaaggaagaagctggcgccaccacgaacatccccatttcggggtaattgattgacctagctgcggtggaccacattccggcggtgggtccggtggcggcggcagcaggacccgcattgaagccgagggagaggtcgtcgacggggacagcgcggccggcaccaccaccagcaccggaggaagctgtcgctgcccagtccgcaaaggcaccagaatctgaaggtaacctccttgtagtagccacaactgaaaatccttgattacttctcaaatcaagagacaatataagtaacaatatatagtttacttcttctgttagtaaaaaaaaaaagaaaaaagtggggtgtatagtaggtggaaagacagaactaagtgtagaactatagaactatagaagcatagatcttctattgtctaagtggtggtgtatatatattattttgtatgagggtgtatctaatgtgggtgttattcttcttggggtggggtcttgtggcagggaaagaatttgttggtggaggaaaagaaaagagagaagttttctcttttgatggagtttagtgtttgagatgagatgagatcttgttgtattgttagggtgaggtggggtggggtggggtgggggagttgagtggagtggacttagatttttctctctctatgaaaaggaagggaaaacgaacaacttctctgcttcttcttctgtttctgctgctgctgctattgtggctactactactactgtcactttggcttttttccacaggaagaaaaagttttggttcgagtaagaaagagagagaaagaaagatcagtttctgaagggtccagccagcagaagagtgcagagtgagcagtgaatgagaaaatgcaataacgacttcttacttactgtgtctctctttctctctctctctctctatctatattttattttctttctctctgctttgctttgttattgttgccgaccttttctctctcttcatatcatcatcatctctccttccttcgcaaacctagctaagcttctttttcttccaatatttatctctcagaactaaagtcctttctttttcttggcttcctatgaaaagtgaaaactgaaatgggttcttcttcacttctcttccctaacctttctttcttttccaattcccacacacagactcttctctctctctccaattatcaggctctgataattagtagtagaaagagagaagaaggggaagagagagcataaagacttttgttctctagtttttgtaattttatggaccctatatgaaactcacatgacgccacttattacttgtgggctcggcgcgtgagcatcactccccgcgcgtagtgcattttctcaccccagaatacctacacaaacaccacttacgtctcaatcccacttcacttggaacggcgcgtggacgcaactacgttctatctgtggcacgcatgtaatttgggacgttgtttatttttgagaataaaattaaaccatgttgttgagtagcactcagcaatatactgtagtctataatctaaggtgtcatccatatctttttccttttttactaagagagtccttccaaccccatatctatgaattctttttctttagatcgtctttgtcagatatcaatttattgagtgagtctctctttaaattgcacacaaagagtttttctgtgatttttttttttttttgcaatttatgtgcatatgctcagatgacagttaatcgaacttaagcttttgcttattgatttagttgttgttttttatgactctgtcaaaaaaatggttgaagattagggtgctgagtttatgtgtatatatttcaataagatttccaaaaaatacacaccggctcttttgtctgtgtccagccatttattaatacttctttacctgtatcaattaactacataaaatgtgtaactaaataaaaataaaaatagtcatagttttcaaataacttgttgttttgacttcataacaaaatactgatggtcttgctggtgttggttgttgtgtacctcacattattgtaactagacaatagctttctagactttggcacttattaagcttgtatggaagctctcactgtattgaatctgaactcaagctttatgcttctcttcatactgaaatcacacaaaaattaaggttttcactccaattttttttttttttttnnnnnnnnnncgtatagaagctattttgttagggtagattgttttggttatcttttttttaaatatatttttcgagttatcatcatacttctttaatgtaaaattcatttcttctaatatataataatatattttttcacaagtgagacttactatatataacttatttttgttttaaataatttactactggttttaggaagggaaaacacaatcccaatgaaacacttaaaaatgagagtgtgttttttaaatgaataaaaactaaaaaaaacttttataaaaactaaaaaaagtattctatttgatagtataaaaaaaattgagtaacaattcatccttttatacttttctcaaagtgttatagagctttttttatgcaagaatagctcttaatgatttatctataaaacaaaatacttcttgcatgggaggttatggagtgcttcggttacttcaagtaaagtcattacatttgtggtggtatatgacagtttttgcgacagacagcttgggaagcttttgctaaataattttgctagtttggttttttttgttaaacataagcagttccaaagttgtctttttacagacatttgatagaagacataaaattaatatttttatttatatttactaaaatggaaagatgaagtacaaaactagagcagtgaaaattcctctgcttgaaataaaatgcatctttcaaatttgaaaaagtttcatcccacgtagacaaaaagaatatctcatgagttacgatgcaattcagatgagacttgagaggacaaaacaatgttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaacatcagcgtacgttgtgctgctaatcaagcaaagaatccgatccatattaactagttttaaagccttcaaaaacagacttttcttgtggttcatagcaccctttgtacctcaagtcctcaactatatataatattaatgccattcacatgtacatattgggtactgctaagaatcgtccaacgcacgtattggacacaaaagcttctcctttttccctttgtatatgggatttttcggtgaaatgaatgtgcttgctgctttacatttatgtagttttctgatagtttcttatacaagaaggacaatacacaaaccaaaaaagttaagcacctgaaatcttccgccactttgcatctgaatgttacacagcgttcactatcttaatttttacttcacataatttttgtaacttgaaataccaaagaaaaatattttttatttacttaaaatttattaagaattataaaattatgagtaaaattcatcaaatatgatgtaaactcacacattgtattggtttctaacaaattttaatcaaggtgtgttagaaaagctatattactaggatttgtatataagtttttgctattattattatttataaaaaaaaaaaaacagtttactcatgtcaaatttttgcatcgatcgtataccaacatttacccaacttaggatactcacatgaacaaggcaaattgctaacaccagaaattgtgttttctgctactatatatggcacccctcaataaaaaaaaatcatatgtacattcatgtaggtaagtgatgaaagtgaaagatatgaagacaaagaaacaagattctctatcatcagcgaatccgcagcataaaacgaggacaatagagcagcagatccagtgacagtaaatttgttcaaaatggcacagtttgttggcgggtgccttgggattagatggtatatatggcctgtgactgcacgtggagaagatgaattaacgagagtcagcgctggcaattcaaccagatgggttgattttgtggtgttaatttgaacgtaaaaattatagttattagtttcttaaaacctcaccccaatgcaaacacgacaattcatgtctaaaatgtgaaactaaacattgtcatgagtctttatatatagagctcatgatcaataatgcagccacaattaaacaatgtaagcctgaaattaaaaaaataagcaattagaggatgtttgcttttccatttgtttaatttgttgccacgccgtgttctaataaagatccaatttgtaagaaagaagatgtgttggccaatctctgtttggtgcaccaccaattaattgtcaaacatgcacttagcaggtgaaagatttgttgttataaaagtatactctgaatgagatatataagtgacaagataatgttagaaaatagtcatagcagaattttttttggtcaagttattttatttccattcagtattgtgaacttattataaacttgatgttatgtagataataattaatatatatatatatagtaattatgttttatttaattttgcgaatatgttgatgtaacatgtataaatttactattaatattgtttttcaaaatgatcaagtcaatttaattaaataaatacacttaggaattattcaaataaaaactattaaatttctaaataaatttaatatttttttcttgttacaatatcattatatatttatgtaaggaaatggaattaaaatataaatgtatagtttataaaagtgtcgtgataaaaactttattcgtaaaatgtgtctatgaatagtatgaatatcaacacttttataaaaaacaataaaacttgaagttaattacttgtacggctcagtgaaaaagttctgagcgttttggcgcgtgtaagatgcatggtggctgtgagtaaattagccataaacttttacatgagaaaaacaacaaaggaacacgaaaccaaaaatataaattggaacatgaaaaagccttcccttgtttgccttttgtgataagctcgtgtcttaaggtcacttcatgggtcgattaattagcagtgttacttttggctaaatagaagatgattaagagcggcccaaagatgaaaagcaatagaatcattgttagataaggcacgtgaaagaatgaaaatcaagtttttgtgttatataattgataaataatcaagtatttaaacaggtatttagagttcatttttcaaatttatgtatatagaaaaaaaattgtaatttgtttaataagtttcactataagggattaattattggagatataagatttaatgaatcataaatgattaaggaaagaaaagaaagaaaagaaagaaaagatgttcgatatcatcggttaataaaattaataattaatgtttattaataaaaaaagagattaatcattaattttttaagcttaaaaataacatagatcacccaaaaaagtgaaagaagagaaagcaaaagttataaatgcaatgcctcttcatgtcctctttgggcaccttcttctctctttgtttggcccttgggggccacgagtttaatttcctcttcagtcttcacatcacacacttctctcaaggttcattcaattcattcctctctcacacatcttgatcttgtgaattgtaagcgtgtgtgtgaaagtaccctcttttttcaaagcattctaaaactctctctctctctctcttatacaaagtgtgttaatgatgcacttgaaaagcaatcacttctcacaccgtgttttccattgtctaactgtgcttaaagccagcttgttgttgtttggcctaaaaagtctttaattagtaatatttatgttgcccttctttgcaaagattattgcactgacgcacaaaagcagcatcttttcttcataaacaaacgcacattcattagtgctgtctatcgttttgtttgttactgtcctctctgggctctgcttctttctcactttctcatctcatcggttcttcccattacccatcagattatcacacatgcatctcattgcttttcacatgaaaatcaaaacatttctaatctagaaaaaaatatagtatttttggtaatatttactacaaagtgcaaaccatataaaactatatggtatatgataactatatagtagtattttatattaatggcatgattcctcgtgcattttaatcccacagttttttgttttcttttgtaggctcggtacgaattaaatacattataatttgatgctctaaaaatatttatattttgacaaccatgcatggatgcaatcgatatttatttaactagtggatttcatcatgctacataatcaaatggagaagcgttttgttttccgtttaatcggaaagggcaaaagtgcaccatattataatcgtaagtgtattacttgagtagcttagctttaatttccaccgaccgaaattcttttgggtacatacatgcatgatcattcacttaactcctacccaagcaaaattaaaaaggcaaaagcaataccaccaaaacaagttgttttcccctccatgcatatgctgataattgtctctatggggctctttatggtttctacaaacacgtaagtttcttctagaactatgcttttgttttcatagtacgatctaaattaatattttgcaaaaggcaatgagaattttaataccataataaggatataaattaattgagtattttattcgaactctactccttcaatactctttcaaattgtttatatcagtgaaaaataaaataaaaaacgtaagttctttgttggatgtcgggttttggtgttgaatccattgacccaacaattctattaatgtaacatacttttttattttaatttattattttgcatattttcataaataaaaaaatagagaaaaacacgcacacacaccccaaacacagttatacaagcaagtatactagttttttcttatcctatctaggattcttaattttagaacaaatcaaaacgtgcacatcttcattgttacatatgattttttgtgtttatagtgaaactgtatgaaagaaagaaaaaatcaaaatgcatatagtacaatgtaactaatcaaaaattatatcaaaatgtcatttgaaaatgataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgtccataccttcattaaaggaattactctaaaagcataaattggtgataattattaaaaaaaagtgaacatacaaatgaagatagttatatatagtaatatgaaattgtagcataaaataataacaaattatttagactataaatgattttaatagtgggaaccaatcttagatcaccaattatcacgtatgataatattattagtttttataataattacttgaaaagttatatataatatatttttaattaattaagagtaaaatatcatgttaataacatatgaaaattactcaaacaataaatatccttgaatgtataataaatcataatactcttttcttctgaaaataagatatcaaacccaatccaaatcaaacttttatatgcatatacgtatatacgtttttatttataaatttattataccatttatgtttatatttttatttattttataattataaaattattttataacatatttatttataaaaacattttaattaaagataaatttttttaactatttgactgaaggtacgtatgtataattattaagtttaatagtacatatatttaaagagttatactactattagttattattgacttataaaaggagatattgaatattttaagttatcctttattatatatatttttatcatttatttaatcttttctcccaaaaagtaaaataagattaaagtaaaaaatcaatctaattcaaatggttttaaattgatcagatttaaaactgaatgatttatatatgaaaattaaagattaaataaaataattttattttccaaaaccgatctaattctatttgtaaaatctaatagtatttcttataacacgcggtgtattttttaaaaaaaaaaataaaataaaatacgtggaactgtatagaattttccttgggcaactcagattcctttcaaacagggtagtagcacagcaaaccgagtaagtatatcattattagacccgaaacgcaaaccaaaggctgccaaaaaaataaattatagggcatgatttaatgaccaactgctatatctaaaaatgggtacacactgtcatgtagctaaagcttaagtggaatgtaatctacgctaataatataatagtcttctctctctctctttcccttagcctttctctctctttcctttcttccttttctctgtttctgtcattgatgaactatagagaagcttcttaaacactcaatcgttgaccaaaacctttcacacccaacatgaaagttgaaagaaactactcaatgagctagattccatcatcacttttctctgaaaaccatcaaacaaagagatccagttctctaggaaaattcacaaagcttgattctgaggagaaaagaagacgttttaaggacgctcaagcttggaaaagctgttctctagccttttctgtcaatttagaggtaagaaacacaagttttacagattgatttgtgaaattgttcttggaatgaatagtgaccattttgtgatagagctagaattaagcttgagttctttagaaaagtatgctcaggaggttgttctgatgaatattaaactttgaaacatgatttttgatgaagtttggttttgaccctgagataggtatgggtaggaaaaatgttgagtaaaaggaagatattatgatagttatgagcctaagtgcttttacaaaagttgttcagaaggataaataaacggtgaaaatgtgttgatatatctgttttagtcattttgggaaattgttgatatatgacctagtagatcattgaattgagattatgcagagtctaaggggactctaagatcttggttggaccaagatagatcctgttgagggtctgtgaatcacctataagatggttagctctgataatcctaagatagagaacagagaggttttaatggaagggaatgacatttcctttcattctaacggctaaggaccgttattgattgattgttttatgtcttgtgtagggcgtgatagtaatcttgctggtggttgtgaccacgaagccaagagagccggtatagcgctgagagcaggtaagctctttgttcttgggagtgtttcccactgttgtgttccaccatactccgagggagtgatggttattgtatatcatgatgtatgtatattgaaattgtgtgattattgttttatgaacatatgcatatgatgaattgaacactgtgatagtgttgtatatgtgattaatgagattttctggccagtagaattatatttgatagaatatatatatgaaagtcctgttgtgagatgtgtccacatagtggatgagcctccaggatgtgcccacatagtggatgagcctccaagtgagatgtgcccacatagtggataatgcctcctcaggccttgatacataattgtaaatatgctatgtatgtgtggtaatatggcttgatagctgtgattactagtttaaaatgccaattttgatattatatgccatggaagtgaaccaaggagaggaaagacctccaaggaccctgagtttactgagattgttatctcacccctgttgggggttatgttttgcaggtgattcttagggagctgctgagagatcccagggcaagaggcccgagcagggaaaggttctgtgagaaccttaggcatagtgtttaagagcatgttggctctattcttttgatacatgcctgttattttgtatcctgatagggattttgtatagttttgaaatatacgttgtatattataagaattcaccatatatgatgtacagtggttgttaatgacgcttgatgatgtcatttagtttatcgcttccaaatttaattatctgtgataattgctgcgcttaatgaccataaatcaatgttaatgaaccggatgcatacggggcgttacaaataaattcattcagtttgctaatttcgcttcttcattttttattcttgacctatttggaaggacaaagaagattttgttccacataatataaatagtgtaagagaagaaaaaacagaatatgatcactactataatatacaaaaaagtgttttaaagaataggttcaatatcaagtgtttctcacattatccgactctattttgataaagagtttctcacattatcccaaggccaagtattaaaagtattaagtgcatgtttgaaaataactaaccaacacggattctataatctctcttcaaggctcatctttcaaatatgaggaagtaggtcttggtagcttcggagttacgagtgtgtcaaagggtcgctcatgcagaaccaaacacgttttaagtcagaacaaattacaatgttgagcgctagaggagttttcaagctaatgcaaaccacaagtagtcaagagttccctatgaactctcacattctctatgttctatataagtttgattttttttaatactactatcatttttttcctgcttaattcaaatgggaaaaggattctaaatcaaacatttgatctaattctaaatatgtggatttaaactatatataatttcgtgttagatttgacgcattgcgagataaatatgcttgctttcaattatttgacgcgacgtcaaactaaaggcgacaaatacttacttataagtaactgaagtgttggagatcgagaatctcctgtccatattaaataacccattccaaacatactgaaagaagaggatttttcctaagtcattttaaaatgttagaaatctaataaatgttgctatagttgctataaaaattttgtttttagtattagtttcaatttttatttcttccaaataatttgtgataaaatagtgcaattaattatatcaattcttgtgagaccgatattactgcatttgaaatgatttttttcttatctttattttccaacaaaattaactttaagacgtaagttaagcaaaatcaagtttgtaattagtccaaactctataacatacaagattcaaccttgctacataacgtagatcacatcataaaaccgatcctatgtgaacacatttgtttggccaataaagtaaagtgtaactcttctaccatttatttcctttattttcattattactaggtatacttgtattaaggacggatccagctattgacggggacaagcaggagcctttcctgttagattgttaaacatgagtgtagagatttcgcgtcaagtagaaaagagacatgttaaacacatataagtaataaaaatctcacccaatatttcatatgttagcaaagatcttctaatgggctttttgacaataaaagggtaaaaaaaaatcagtaattatcatatgagatatgagagtagttttaaaattatttatcattttgaaataagtcgggttaagtgatacgacttctaaaaagaatttgtaattctatttatttacgattttactgttcttaatttttttttacgttcaaaagtcgtaattatatttacgagttttttactttcaaactgtaatttttttccttttaaaagtcgtaaaaatatatacgagtttaaagttgtatatatatttacgattttaaagtcatatttttttattttttttttcatcctgcacgactttaaagtcgtgaacaatctcacaactttaaagtcgtgtacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctatttttaaagtcgtatatatttacaacctttgaatgtaagaaaaaataaaaaataaaaaaatttcagtttaaaagtcgtaaatatgtttatgactttaaattataaatatatttacgacttttgaacgtaaaaaaaattatacataatgaagttataaataaaattacgacttcacttaaaaaaaaacgaaaaaatataaaggtcatgatagactataggacttttgatttacaagttgtaacacgtgacacgacttatcccaaaatggtaaataattttaaagctactcacatatggtaattattgatttttttacccctagtcaaaaagcctcttctgatggtctgcgtgtaatttataaatttttattaaaaatattaattattaatttgttaatttttattattaagaaggatttaaatctatgatatatatatttttttaaatacttttaaccattaaatcaatcctacctatatttccataactttacctataatgtgttacttcatacaattcttaatactgttttttttacttgaaccaaccatactaatatgttgattaaaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtatcaaatttaaaaaaaaaaaacttataaaaatcaaaaacatatttaaatctttttttattataaataacagtgtatttataagaccaataaaatttagtataattaataaataattgaattttttaagcatgttaagagtaattagattttcagattgtaaatatgaaaaaatttgattaagagaggaaaaactcacttctaatctaaatgtgttttgggattaatgttacgacttttatatatcaaaatacattgtattttgcttttcaagaaaggaaaaaaaaacgtgtgttgataagaatcgatacaggaagagtttaaacgaggtgggttacaacttacaagttcgtagttactacgaggacaatggaaaatttgcaatggttgattgatttaaaagaaaaccatgagagtggagagaagagggtaacacaagtgggggcaacttgtataaggaagacagctagcgaagtgaagcatggtggtgacttctgagtcacatcaaacgtaaagtccaaatatgtcaacaaaagtcgcatcaccgtccaatccttatccaccgttgacccctaaacagtgtgccagaaattatgaatgaatgaaagttgcaaaagtattagaaatgtagaataaagcaccaatctactcaaatccaggaaccaatgtctctcatcctccaccttctcgccatttctgatcaccattccatggattattgaactattattatgcttgtttgtatttaaattgtttttaaccatttaatataatcttcattatcatttctctttcattgatcatatatgtactagtactagtatacaacatttaaaatgcactttcttgcagggcatgattggcatcaaatactccttacttcgtgagtctaattgacctaaaatcctggaaggacaaattgtggtgactggtgggtcaaaattacgaacacaactcattatttgatgaaaaataacatgtgactcatatcataaacataacaagtgtaagtgacggtactttttttcagtacatatcataaatatatactccttcttgtcttaattataagtaaaaaatatatatatttcatatttattaaagaaattaattaacttcattaaattatgtgatttctaattaaaaaatatacacttttttaaaattattatttattgaaacttaatattcagcattaaaaatctttagctttaataaataaaaaatattttaaagataatatcattgaataaaatataagtaattataatttgtttatatataagaaatttttgttactgagagatcaaaagtaacatatttcaataaactatagtactttgttttctttaccattttcaaataaattaaccattgtggtggttttgacaactcgcaatataaattaattacatgtacttagatcctttactgtctaagaaagcctaacaagcataaacataagcatttaaatgtctttctatttctttatatagtcgttatttctttttatgccgaagctaattctctccttgaattctaaaattttaataatcattatttttatagctatgtaggtatattggttattattcaaaaaaaaaaaatgcagaatctgggtttttgtcctaacattctaaaatgaattttgttggagattttgctgtctgaggggctcagagcaacctcacagtgtgggctcagtgttcaaacataaattccttcctttctttaatttcctttacccatgcaagacagcctgccaaaatgcccatcattgatgagccaatggcaggaatatacgaccccttcaatactacaataatgtaatcgccaattattttgtctgtatatctatcttcgtatagttgttcatttatgaatatcattaaaaatgaacagcaatatttttatactttttataattaaaagaaaaacatagaacaaagggagagagaatttaaaagtaaattacctaatgtgataaaaaaaaattatgtaaaaaccttataaaatatgcctaaaataataaataattattcttataaatttatgattaggactgtttgaaacatactcctaattttatatgcagtatttcactgaccattttcttctttgaaaaaaataatctaaaaatggattttgaaatactgcaatgaaaagtatccaaatattattaatttattattcaaattcaaatttcgatgacttttattagaaaatcacaagttttgtagttttccaacccgaatttttaatggcgcttcaaaacaatatcataacattaacggctaaacctaatattattgagaaagcatatataatttcattaatttcttatatgttcttctgattttgaagataatttatggtaattaaatctgtgaatttgaagatataagtaggacaatgcttttgccagtttcggtctagatgatttagcattagctaccatgcattttcgggaagatcatatgcaaagcttattcaattagttttaaaatatttttgcttaaagatcaacatgtggcacagaatttataggaatccatgctaaggaaacttcttcctcttctgtcactgcttaattatctgattggcaaacaaggcctcatatatatatctagctagctatggttctttcttcctcctgcaaactcaactgtatacaaattaaattttgactgccaggttcgctatacaaaagcctccctagtttgactaaggctacacattgtacattcatgtagctttcctagcttgccaactaatcaagttggtacagaaaaaccctaaaaagtacatggagttgtcattttctctcccccaacgtcattaatttctttattaactttattaaatatatatagtaaaatatatcctgacttattctcactatatcaacatattttataaagaataaatttaattaattgtctttgaagttttgtaaaattacataaataatactctctgcttttttttaacctttacaataatcttgtgttacacaagctactctggtgtaatattttataaacaattaagatgaattggtgtaatatataaatgagcatgatcagggtatatttttcaaaatttaagaaggattagtgtaggagtaaaaaaaaggaaatatttgtgtaggttcataaaactttaggataattaatgtaatttattctttcgtacactacaaggctgtatttttttgttgacaaacactaccctaactaacatctattgtgaaaagttttgcaacgacttttaaaacataatcataattatttcacaattactattatcatagttaccattccaccaccactattgatacctccattattgttgccatatataaagtatgaacactctttttttggtccaaaatgcatgtcggacacgtgtcggacattgatatacagtcaattttttaggacacgttgagtagggggacacgcgagtttgatcgaatcggacacgtagtcaactttttcgacatatttcaacacgtttttttaaattattttttttttaaattaaaaaattaaaaaaattaaaaaaaacatttgataaaaaattaaaaattcagaaccctttatggataaaaaattaaaaaattaaaacatttgattcacttgaagatgttggagatcttcaagttgccagtctttcacttgatgagtcagagataaaggctatgattattcgagatggagatgaaattaattaaatttgttagtaacactttatggatgttttattatttttgctttatatatattaaaaatattgtttaatatcaaaacgtgtcctaacatgtcgatattttttagaatttacgtgtcagaatgtcatgtcgtgtcgtgtcgtgtgtcgatgttcgtgtatcataggttgccactcccactccattacctttatcaccaacattatttcatcttagagcgagataagataaaatagttcacttattttatttgtttttaaattgtagcatctttttaaaatttaaaaataaagaataactcaaaactcaaaactaaaactgattttatatttgcaatattaatttcgacctattgattttttttatattagtttctacaatattaactaaatctggaattaaaacggctcacaaaaaaaaaaaaacaatggaaagataactaataaaggaagcaagagacaaatgggcctcggcccgtggactcattagaaaattatggcccggtttatttcgcaagcctgatctaagctgggatcactgtcttttcacatcatttagcaatagtatctcaataatgaataactttttttaaaaaaaatctccagaaacaatatttttttttcgtagagaatctccagaaacaaatgaataatcatggtgatttaaaaaataaataaaacaagtagtggtaatttatttcttgctttggcattgattatgtgttgtctaatttctacactcacattcaattctcaaaatgtcatatattttgagtttaatttcattctaacagttttagattttgaactaataaaaactaatattctgtcaaaaaaattaataaaaactactactcaagatagaatttaaaaattatttattataaaaaaataaaaaatcaacaaattcttggcacacacagttagataatgatgatataaattcttggcacacacaattaataaaaactactactcaagatagttttatatttttgtaattttgagtttttcctcaaactaaaagtattgatggttaagaaattaacatatattgatcatgacatagattaaaaagttatctcacatcactaaatttagatcatatgaagttaatttttatcaatcaacattttctgaatttgataaaaaaaaaactaaaattataaattttataaaactggacgattaaatattttattttaaaataaagaaataaaaattatgaaatttaaaaaataaaatgattaaatatttatattttaaaataatgaaatcaatattacatatatttaaaaataggagtaacaaaattacatataattctatattcttaaatattagatggtatttattagaaatacatttttttaatcacacttagagaattggattggcttgcctgaaacaaactcattgcctttttattagaatcacaattaaataactattatgtaatgagaacactggcaaatgcctctaatgcattgatcaaggaattaaaagtgcagaacttttacaaataaatgttaattacatattttcattgtgattttcaatgtaaatctacattcatttttaaacctaattcattatttattgttttttaatttagttgttttaagacactcatgaaaaattcttattttatctactccttttttttgtctacttattcaaaaatttaataatgtgtttatttatattaaaattaatttcaatttattattatatttatagaaagtaaaatattcaacaagtagatagaaataaaaatagaaaaaccatatcaaattaaaaactactaaataaataaataaattttaagaagtagacagataggaaaaaggaaattggagtatagtgatatttttagtcacactttgcgggtaacatcggcatttcattaaagtgcgcgtgcctgtaatttcagggttattttgtggccctctaacctaaacctagggtccaataggaggtatgttgaaagatcgcgtttcaaaagtatgatagttgatgctttttcagtttacaatatgaaatcccaatcaatctctcacatgtatttcagtgtaaattaatcgacaaaacctaaaaaaaacgcttttcgccttgagaattcaaggtctgttatagtggcgcaaatgaaaagctatgtttagttaagaaagaaaaacttaattcacatacaaacaaatcaagtcacttataatttattaagagtgtttaaattgtattatagtccgaatttctttttaaattaatgataaataaatatttttattattttaaatatcctataacagtaacacttctaattttttctatttttctttttatcaaatcaagattttatcatatctatatgaggagtggtaataagacactctttcaaacactcctccataacatttcttcttagtagttaaaatgtattaaaaattataaaatcaagaaagaaaatcaataaatagatttggatccattgaattttgtaataaatttcaatcaataacaaagatatttaaaagagtatgttaaaaattataaccctaacatttatttatctatatttattactctctttctaattctagatgttacataaacgtttggagtgtccattaaattttatttttctttcatgtcattcatgaatgtatgagtgttttagttattaattaaatgatataaacccttttttttaaataaaaatgttatagtatataaattaaataaaaaagtgtgtaaaaataagaatagtttagtctttaattattaatcaccttatctttcaacttttttttttccaaattgaaaggtttgcatttagatatgagtgtcacaaatttatttttctttcacttttaaagtgcaccaaactgtataagtaaagataaaatttctatttccatttatctaatacatcctttttctaccatttcaaacatgatgaattttaccatgcaaaaagttaaacattttttttatggtatgaaaaaaatttaagtcattagatatatttttgcttatttgacagatgtgcaacggctgcaaaggattgagggaggtgtgatggtggtgcaggtttgatagaggtggcttaggattgagaaaagggacgcaaatttgcattagagagggagggttatgtctgaaaagaagaaaaaaaacaaaaaatctaaactaaaaatttaaaactaaaaatttacttttctaccgtaaaaattgtttaactttttacatggtagaattcatctccaaacataccattaatctgctttcgtatatgagagtaaaaataaataaatttagaagacaggttctaggttgtttaatatagaataaaatgagcaaaatatttttatttatttaatattatagaaagttaaagaaaataaaaaaatgtatataaaataacttaaatacatcaaataaaaaataaattgtgatgtttttcaataaaaatgaaatgaaattcattatagaaatactttccttcagtccatgtcatcggtgaaggaatcaataattttatttaataactttaatatttttgttgttttaaagattttcgtttatttaaagttatctggtatttttaaagtataggttacttttagtttgagttgtaaattttattttttaataaaataagagaaaaacttaaaataatattttaaattgaattttaataattttatttatctttcttagatgtaaaaaatatgataataataataataatatattgaaagatgtactatttgtttgatagtactggtttttttaaatttcaataagaaaaggaaaaatcagaggagagagagagagagagaaggaggtcggaaggagacgtaaaggaaaatgatacttggctggctttactgagggcgagaaggcagagaggaaaaaagaaagtaaagagggggagaaagtggtgacactgcagagacacaagtaggatatttgtaataaatttgaataattaaaaaaatgttgctaaaatatatattggtaatttgttaaagtttctataaaataagttaaaaaataagaatttggataaagagtaaaatattagaacatctttaatggtagatcttaaattgagatcttaaatcatgttggatcctataatatcacataagattaaagatctctcaagaattctctaattttttactttaatggtagatctcattttgagattttaaaatgaaaaagagagagaaaatttatttttttaaataatgtgtagatcttctacgatcttgtataaaaatttattttttatattaaagatctttctattttttttaattaaaaaattttataaaaatcatattttaaactcaaaatctttaattaaaatttaccagatgcacttaatagtaacagatgcataatgatggagagtgttattgggtgaagagtaatgagttagttacggtgatagtagtggaaggcagctaaggtagagaacatcaggaggtgcctcgagcccttcaatacatcaatcttcacgcgctttcttttttatcattttatcaagtgggtcccactactcacgccatagagacacccggggggcgcctctctcttacatttccacttgtctactcacctaagctatccatcaattattttgtcattattatataagacaaacttcaacatctccacacgtgtctctttcttcttaatttctccactccaattcaattactaacatattatttctgcatttcttcatctacctcattacattacattacattctccttaaattccattaataaatacactatcatatttattataagatattttatattaaactttgtattacaaattatctaatatttaaaccttttagcaaaattttatttaatatattaaaccattattgttgaatatactatacgaatgtaattaagcccacccatgctttgacccttcttttgtggctgcaaccttttttctttgatgcaatatacaaacatggatgctaaattcttcagactgctttgcacgatgatgggtacctacggctacaatcataataccatacctttttacttcatcaacacgatgatttgtgttattatctattacatccttgcatatctataagatagctcgatcaggacctttgtgaatgtatttaaacaaatactttactgaattggacttattgcaatactcgacgttgtcatgccctccatttcgtataagaagataaggattgtaggggaataacactacgattatctaactttacccccattttcttaacccataaaccagaatcatgacgtttatacttgggataaccttggtcaatgtatgcgcttgtatttgttattttaaattctttttaaaaaacattattattttatcaattatatatacttatatttacttgatttttgtagtcattgtatatacttattatgaaattaaaaggatatagaaatgaagaatgataaattaaaaaaaaacaatatagtattcattagataattaaaaccttaatagtattaaatacaaaaaaaaagataaaattcttaatataaaatgacaatattaattgcatttttagcttttacattccattttgatattatacttaaagtggaaaaaaaaatagaaagtaattaaaaagagggataggtatatgtacccgttcggtccatttaaggtccgacttgcgaaacctgtattttatatgggtcagacaaatctgatctattaaataaatgatcttatttttatgatttgtatctagtctataaaagtctgcgaataaatggattaatcaactagtcgtaataaaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagtaaaaggagataaacaaattataagatctacaaaattaagttaaatatttgagtgaatttttgtgaagaatgcttaaatctatatcacattataaaatctataaaatagagataaacaagccatttaacaatgatcctctatcattagtgtattcctaactaatatgaaacatcttaccacactcttcatgcctaaaattgatgccatattgtgctgattgctgaatcaattgttctaaaatccttaattcgtttaatgaatgcacaaataattttaacactcccccacataagaatccattaagtttaaaatatagataatgcataaataataacatggaaaagaaattgtccttttcctctaaaactgatcgaaatcaattcgccaacaagaatacaaaggaacgtggatttgtacccgaacaataaagaacttgcaaatttgcatgtagatgatgctacattaaaatcacctacgatggtctataaagtgtagtagtttgtagagtggtccctcacataaatatcaatagcagagaaaaagtctgggcttgtttgcttggttcagtagactcagtacagacccctacgcacacctactctctcttttatgtaatctcactgtcattgctcaaatcttcagaaccctacccctcatcttttcccagccattcacatcaccattttttttatactaattttattctttaaataccagatactcagataattcacttgacaccatctataaagtgtataatataacactacccatccccacctatatatcttcttactgtatactcaattttcaaactttcttaatatttcacaaaataaacacttaatgaaataacacacattcaatttttcttcatgggcataaacacattcaaatatttttctatttattaagttggaaggtttgaaaaaatacattgtaaaaatattattaaagatttcatattaactagtgatatgaataaaaataatattaactagtgatatgaataaaaataatattcataataaatgaaaaataacctttattttattctgcattatttttgcagttgaattggattcaaatctacaattgaatatgatattatagtatattttaaaaatgttgttaggtttatttgttgttaaatatatcggatcacttagactcactgcatgttcaacttgtaaattttatgttcataatattcagccatcaacatgagaaaaaagaacattcacttataaagtagtttttggagttaaattaatcctaaactgaaatttttatattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtccagttttgtttttcctttactttaagatgctcacgaattgataatgcaactcatattatctttgtgtatgagcattggctatatatgttttatatttgaatgacacacgcaaaacttttattttatttcacatgcttaccaaattctaacattgcatcattcattttttttttctttcttttaattttatttttactatctaaattctcaacctctaatgtctacatatcaattatactgaagacggatcaacttaattgtcaaaagagtatcgatcttttttagaattacttttcatttttattatttattttcttaaaattcaatgataattataaataattaatcctaatcattaaatttataaaaaaaatcaataattaagataaaaaaaagtaaaatacaagaagcaatcaatccatatacagaatacacaacagacaccctgtcaataataaggttctaccctaagcacttgcagcccttcaaacaacatagagaagtgttctattcaagaaaagcatatgcctagctatagccacatcatgcatccactatgacattacaaccccttcaaacattccatgggatatattgaccactcataaataaacaacaaaagagaattccttcaccctgtttgatagtcatacccaagatctaaatttagttaattccaaggtacatgttcagtattaatgataattattgttgaaaataatgttcattatatggggtaaaggcatggaagactcgaaggaccacactaggatgcactgaattatttggttcagtacctgctgggtcaagcttatttaagcgtgtaacaatggctaaattaaatggcattaaaacaaaaatcttctggttaatataatgcatataatttcctttcagcctttcctttctttggagtttggacccgctatactgaggtagacacgtactgaattaagcctctaattaatttgacaaagaggattttctccttcgctgtgtctttgctgattgattaattttttttattaataaatattaatttgttaattttgttaaaaatatcagttacaatctctcattcctttcttctttctttcttcttccttcatattttcccaattaatgaatcaaccttatatctccctcccttgttgttcaatgcatatataacttcctacactttttgcttccacgcaaggttagttaccagtactcgacacattatcttttgatctttttataggttaacgtttggatatctaaaatatgtagctacataatattacgggatacaagtagaatgcaataaaattaccaaagacggaatgaaataaaaatttattagtttataaactatcccgttatacattgaatggatgacacaatatccatttttattagtttatttatatgttatcctatttaaaagaatgttgtcactcctatttcacattcttgcaataaagaaaaagatcgataaaaagaaaaggagagaagtgtaaggtgataaaggaaaatgcgcagaaaaaaatgttatgaaaatgtgaaataaagtatttgtatataataaattatatatatatannnnnnnnnntatataataacaactactatgatctatttaatttccatctatttcatttattaatttctaacataacataggttttataggacaaggggaaacctaggtacgtcttgggctaggagaaagtcctaggctcttgacacactatatatatgctttccagatgctcaatttttgagagtctactgggtgtgtatatatatatatatgagggcttcctgatcagaagttaagtttcctcaagggttcaattctttgcaaaactgatgatgtcttttacaccaagttcctcatctcaagacaccttggtgtagctctctatctatgttttcatcaatatttatgtttagaaactgtaactgactgtctaatagaattctaaaatgattcatgaacacttctcgtctatttaatttgacacttggtgagaaagagaaaagaaagaggaaagtatatgcataataagtaatattatgtgataaaaaagagagagaaataaacagaaacaatgagtgttaatcagctgtttcatgtcaaagtgtccacatctatatatactatccttcaatagaatttgtaattaattttttgtctctatctcactccttatcaatgagcagcaaatttttttctgtagttatttacacacggaagccgaatatatgaatcacaaaacttagagaaaatgaccttataattgagagggagagatctagagaaatgaagaaatagatgagtgtgtaaagaaaggtctgcgatctatattatttctagctgtgtaaataccacgagtctaacttttttaaaccactctgcagcaaaatttcttcaacttgcaattgatataaatacaaatgaatatatagttagtagtcacaaagtaagatatatataattaaacatgacttagaattggggaacaattgcaagtttataaatgcaagcttcactttgtacatcaactaagaaatgcattaaacaactcagaaaaagttgaaacaattaatttccataatatcattcacaaaattataaacaaccaggaaaaagaaaacgagtggctaattattcctgaaaggccagaaagaaatataattaatgtatatatcagtgtacaaattgatgttttgtgtgtgtggagtacttctaattaatcaagaaaattgaactacatagtaaacatttccacgggcttttctttttctttccactctaaccctatgaatctgcatggcgaaaacctaatcttgtattccgaaatggtttcaagcttaggagaccacacctgatccttagacttcacaagctgttcatagtgcttttgcaactcaggagtactacacagaaaactagaggggctaccaggggttgttccaacaccattattctctttgttgtgatctccaccacttatgagcctagtgatgaactcaggcatgaccttaatagcaacccttccatcagaacccttcaagtactgaaaagggcatgcaccaaacttgataggggacttgttagggcaagatccaagggcagaaatggaagccacagtgaggttgttgcatgcaaagagatcaatggggagaacaaagtaggtttggccaggcatgagtttatcatctatggagagaacaggaattggttgtccaatgaagaaagagtctgcatggcacaccatcatttcagggaactcaaacatgatctcaccagctatgtgtttccctttaagggatcttgatgttccttcccaaaatatgagcttcacggattttgatgatgatgatgaattggtgttgagttgaaagcatggagtcttcaatgcgtttcccatttgaataagagagaataatagagagagagaagtggtgcaagctagctgcttagacaagaatatgatgaagagattatatatatatatataaggatatattataatgttgactttggataaaatagtgtggtcctaattttatttcattatgtttttggtacaattaattaaaaagtttgatggggtcggtgcggtggtctggtcagccatgccggctttgaaaacttcactttctatatcgtgatgtgtgtgggatcttttaggacacactcttgtgccaggctctatagcaaaaacaactcatacacgaacttcacaagcttaacccttgaccttgcgtgccttttactatttatattcaaacctagttggttaccctttttctcctcccattaatataatgcacaggactataggaggagtatttagggttttactcttttaggggtgaagattaattcatgaatgtagatatttttgttcttataaagacctaaaagaaatataaaaaaaaatgttaaaattcttactttgttattaactgcgtatgaatagtcggcactttatacggtccagcgtgggggacgaaagtacaattatacaattaaagactaataaattaatttcatatcttaaaggttaaaaggcgttggaaattaaaaaaattccctcaggcagaagacgtgtacgccgtttttgttataaaaaaaaaaaaaatcctgtagagttagtaaattttgatcaaccatatataattttgatcttggattaaaattataacacaaattaccgaattacaaaagattttacatatgcttgtatattataaagtgaaaataattcatatactaatattatgaataatttttataatttcatttaatcaaaaaccgtgggtataataattctattaacttttatgacaattacttaagtcatatttattatcttttcatggttgagacgactgtaaaaacttctacagtatcgatgcatagaacttaaataatattataaattagaatttttaatttatttatcctaaattataattataattatataaattttttcatattttataaaatgaacagaatgattaaaatactacttcaaagaaaagcagtttaattataaaaaaaatcaaacctagctaaattctctggtttatcttcactacttgaaactcaagtaacattttttttgggtgctcaaactcaagtaacatataacatatacttattttgatatagaaatttaatcattatccaaagaataagttagatccaatcatctcatttttttggataaaattaaccaccgtattactctgtcatttgtgccaacgtcatcgaaaatatgacctaaccaatcatccgcgaaggcatctctaagtttgaatttgttgactctatctaatccgtgatttgagctttaaaattttgttgattttaaatctaataaacccaactaattcatttaatattcataatttaaggagtgactaatatatatttcaaaatcagtaggtgttcgtttggttctttcaaactaaaattaattggttcgcaagcaagttcccttcgtcataggctgatattaatcgaacccaagttgtcggcttaagatcaaccttgtgactttcacgtgtcaatttgctgcttttttttatattatgtaaatgtatagtcaaattgcaggctataattatataatccgtttaccatttttatgccttcgatagatataatagaagcctattattaacgtaattagtttaaaaatttgtgaaggaaaataatatttccattgtttatagatattcttacgaattaaaaagaagtttatctcaaagacttaaagaagttcgatttactaattttctctcattttctattttgtttgataaattgttttagcctttattaaataacgtcgacccttttcgtaagtcacctttcggataataagtgaactcatcaaaaataaatttgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgtttcccatgtctaatacaagtcaattagaaacaatttagcatgtcatctttagacaaagcaatgatatgatgtcgttagattaatagactaaaatccctgtggccaaattgtgggtcgttcttggtaccttcttgatggggataatgggggatgattgtcttaatcacatataaaccattttaccttggagatcaatggggtggcttgtgtttaagcattcgatttaatatatttttgggtttggttagcattatgctttgagttatcgtaataatattgttatttttgtgagttaattagttatcttaatattgtttgatgtcaaatgaacttataactattttgataattaatagtaaatgttttttatttattttaaattaatatttttttatgcataggaattaaagatggatagagagagacagtttataataactcatataatctgtttaaacaattgaattagactagttggtatagtataatatgtgaatataattaattgttgatatatataattgtttttagaatatatgttgttcaacatcatttagtttataatataattatacttgtaatatttaatttatatatgtgatcaaactatggaatcgatcaacatattcttaatcattattatgtatcaccagagaatagagatgaccacataggattaggatctacaaaaatgatcttatcaaaatattatagcttcagcctcttaaatgtgaacccgtacaacttatcaaaattataatccttattggctgtagttgttacgacacatatgttagttcttttttcaagagttacattgaatttataaactataaacaatatactcgttattttaaattttaaaccagataaacattttcaggtaatttcatttttcagacacacgtataccgtcacgtatatgtgttttaagcaatacaaaaatacattgacatttaaatatttaagacatatagcaatgcttatatcatccaagagtaagcaaattaagctgaaaggatgatatataccaccccatgtgttctggtcataatccatttgtcgttgcttctaatttgaaggcttttgaatacttcaattatcatgatatcatcccactcaacaaactacatgtccatatacattccggatcatgattcctacgtgcattaatctcaccattcaaacgggcataatgatgaaaatccgacattgatcattcctttctcaatatgattattaatagttaataataaaaattagaaagttgggtgtctgcgctagtttgttgtctgaaatggaatatgattttttattttgtttaaacttgaagggaaaggtgaattgatccattctttaaaaggaagatttagtcattacattgcatcattcctgcccttcaaattataatctggtctgctcaaatggaaggcagacaaagaaagcaaagccaaaacatagcatcatttattcacttttattacattttcttaaatcttttaaatgggttgagccaattctgctcgctgaactaagatgaagaactaatttatctgactttatccaaatttctcacggactatatttttgttctgactgagctcgtaggctcattgagctgggccaaattaatatcttttttttaatctaaatttgtatgaattttaaaagaaaaaataatatcaagccaaataaatcctaatagttttcgaaatttaatttggtcagggctaaaacttcatcatgcactctacaaattttctaccaacactcactttcattacaggaaggatatttctgaatgtatttttacagtctagattacctttttccgtaatgaaatggggtattggcgaaaaaaatttagagtgtaaaatgaaactcatcctaaccagtgtggttcattgagccgaattgatccaattctttttagacctctacgggtccgctagttgttaagggccttgatcttaaatttaaacatcaaaaaaatcatttttcttgcatgaataagaaaaacataactaccaccaaaattttgatggttaaccttaaatttatagacgagttattttctttttatgattattatatgagttattgcatcttacaaaataatatagaacttcaattaatcatcatcattattatgattgtcataaatagagtaattagtgtgtgtctgctaacattagtatatttaaatagtttcacgatgcaatacatcatgaattagattttaaattgcataatttttctatagacaaaatttgtcatatgataccttttagcataacagttacattgatgaagctttaatatttgaaaaaagtcatgatagatataattttgcctactttgacacttaatgtaaatatacataatcatcaagataatactatataattcaataaaatagataaaacttattttataacatattaaagacgttattttacagtgttacacacactcacaccactatatttaataactctttgcatgatcaatggctgaacaatctctacattttgtatcatatctttgatccttcatatatgcagagagagagagagagagagagagagacgcacacatatagcatgtagacaattcttaataagggtagtagggactgataagaagcagagacataaatgattaaaacattgacaactgaaatttaaacaacttccatagtttatcacatagtacgtgtattttatcgtaatctcaaccattggttacaattgcacttttatcctctaaagtgcacagttttgtttcagaggaattaaatccaactatccaagacagcccgtggtagctcattagaactaaatagcatgctactgctggcatgtgtacatcatgcaaatgtgttaaggaaagtgctagctgatttgcttatgtaatgatgttgctgaagttcctcgtaccaagtgtggacttcaaacagatcacaatctcccgaaacatcaaatgtgtgaagagtatgtatatttaatatgacggaaaaccataccacaaaagttagttattatagttggagagagtccaaagccccataaaccttacattagaatcccataggactcaagttccacaccttgaaattggaccccaacattccaccacactccacaggccacagcccctgcgcccatgtgggtaggctatgcactagctctggtcaaacactgtaatgccatcattgcaaccagcaccacttgtttgcagctgggagacataatataaggctctgatacaattgatgagaaccttagaagaaccacaacaccaaaactagttgtagttataaatcccacactaaaatgtcatacttccaatatggaactcaagtctcataccttgcaattggatcctaacttccgaagtcctaacagactgtttctaggatttgaatctatggccttcaagtcacaatgcagatgcaattaatgtgccaatagattacatccctcttaaccagtggatataccaacacttaaacaatacggaaagagttcaaaattgggaaagcaatttcatgtggatcgtcttcaaaaatcacaaaaaaaaatctacaatttgttgcctcaatttctaactgtcaaaaagtataccccaatgatggatatgattatatcagtctaaccaaccacagtcaattccacatcatttctgtgtatctgttaaataaactttaattggaatgtgattgttgtattaaaactaacttgaaccagaccttaggtggtaaccagtgaccactctcatgctacttgagagcaagaaaaaaagaatgcttcaactcccatgctacgcttcataattgcaatgacttccaggcttccccttcaataaattatacttacaaaaacattagtctgaagttcatgaaagatggtggagtcccccacctagctcctgcaaaccatgcttagaagttagaaacatggacaggttgcatttccaagcatctaaaacatacaggattcttcggttcaaattgaaagttgcaagatagaatctcattgtttaattaaatacaaaaaaaatatatataaatcatgtctgataacctaagaactattattctgtattacatctataagcatgaaacaagcaacatcaaggcattcaaaattgcacagttataaaaaaacgagaaaggagtgtctccttttttctttgttactaacctgggcaggaaggctcaacttttatgtttgggctcagaagacatcaaccagggttgtgcttcctgtgatatacagaaccagaaccagtgtggcataggcatagtctacaactagacctaataacacataacaaatatacatctgaataagtaaaattatcataagaatacaaaatcagtgcttacaacagaatgaggcaaacttagatgtcaccaaacgaaagaatatccaaccttttatatcaggtatttgtaacaagagctgcagcggtaaaagcatcagaatttgtcatctggcacaaatcccctttgcagcatttcatcgtggaaacggaatgcttctttcaagttgtctagagatacatgcccatttatcaatgatgtgtatgttgatttatcaggattgatgccacagtcaatcatcttgcataataccatctcagcctcccgcattctgccttgcctacaatatccaccgagaattgcattataagtgatgacatctggcagtagccctttttcttccatgttattaaccaagacaaaagccctgtcgaaattctcttcctttacaaaaccatttataagagtattatacgtaatgcaatcaggagaaactccttccaaaatcatcttttccaagaagtcatttgcctttaacacattgccagcccgcaaatggccctttataacagtgttgcaagtaaccaaagtgggcttaacacctttttctatcatttcatcccacaccctgaatgcctcacccataagtcctaaactgcaaaacccatttatcaaaatgctaaacgatacgtagttgggcaacatccccctgctcaccatatcacgccacaactccttagctttctccatttcaccaatcttgcaaaagccatccatcaatgtattatatgtcacaacatcaggcttaaggctcctttgagtcattgtctcaaacaaaccaagcgccctactcatgttcccatccttgcaatacccatgaatgagagtggtaagggtatagtaatctggaaaaactcccctctccaccatctccttaaacaactcgtcggcatcaccaagcatcttccccctacacaacccattcaacagagtattatacgtaaccacatccataacacaacccttttcaaccatctcgttccgcatgttcaacgcctcagtcacattgccattcctgcaatacccgtcaataagaatggtataaatcaccgtatcagcaaccaacccagcacccttaatcttcccaaaatactccaacgccttgtggaagcgcccgttcctggagaacaccccaatcacagatccaaaactaatcaaatcaggaacaactccgtaccgcaacatttcatcaaaaaccttctcagcctcacaaacatcatccttcctacaacattccacaagcaagggattaaaagtggcagcatcaggactcaaccccatccccaacatctcatcaaaaacacccctcgctctcacataattccccttcttacacaacccattaacaatagcattataagtataaaccccaggcttcaacccgaggccccacatcgagttcaacagctcaaaagcctctaccacattcccctgacgagaatgcgcgttgattaaagtgttataagttacaacatcagggaaaacacctttcccctccatttgggacaagaaaaccttaaccttgtcgaacctcgcctctttacacaaagcattgaccatgatgttgagagtgtagacatttaccgttgtgccacttgcgacaacatcctcgtacactgtccatgccaagtcgacccaccccactttgaccaacgcgccgagaagcgcgttggaggcgttgatggaaacggagaagcccttttgcctcaacaagcggaaggcttcggagccttctcgaagcttccgggactgaacgtaggttctgatgagcaaatcgagaacagtggcgttggtgggagtggaagtgggagtgggagaagaaggaaggagggaatcgatgagttgggcgcgcgaaacgccgcgttttcggatcattcggaggaggagggattgggcttctgggaggttccgggcacggacgaggtcgtggactgtgggacccgcgtgagtggagttgcggtgacattgatgaagaaggaaagatgaaggtctgagagtgtgtatgtgtaagcgtaggttatgagtcagtagtgtcttcgccattgatgccaagggaaagaccagacacggaaggaacaacactgggaatgaaccctcctactagcatgacatggaaacttttttgtttttctatgaaaaataaattatatgtttttttttttcttgggtctaagaaggtatggtgagaatttatatataatttaagtagcacaatcaaagttttttctattattctattatttgatttatgtataagattttattcaatccgtgcttggaaattagtgattgatttcatctataaaaaatttggatttttttaaaatattctttaattcattaagtcaaatactaatctatctgtgatttgtgattacaattagttaaaaaaaatcattatatctttaaaaaaattaaatttttaaacacaatttaataagtatttttttattgaaaaagataagttgttttcatgaattgaaaatttatgtcttatgattttttttaataattttttctcttttaattatttttatatttttttcttcattcaaacgatttttttatacatataaataaatcccaaatttattattttaaattattttcagcaacttaattataattatattgattataataattattattaaaataatttaactcctgtaattgtcctaagtacacctatcttgttaaacctaatcgagcaaaagtttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaagaagaaaaaaagaagaaaaatacttcatctcaaaaagtgtcctatttattctattacaattcatctcatattttagagcatgttaacaagatatgataaacaatggataagaaaattagagtatgatgaactaatttttcttaaaaatttaataacaataataataaatatctatatatttaaaataattaattaatacatatatatatatattatagatttattatattattattatgatactaagaaaacaagacaagatagtgaagatactaaaagtatatgttagtaaaataagataaactagtttatcatattctatctcaccatcaattgaattttaaataagataggtatatgaacatttgtacaatgatggcatttgaattattcgaaaaaaagtgattgcatttgaatttacttatttcactttttaactatagataataactttttttctttctattttttgttattttttataatttttttttctttcagactttcactttatcacaattaagacatgactaatggtgtatttgaattatcgttacgtagcttcaaaatgtctgtttgtaccttttgaaaccctaataaaagaagaaggaactatatattaatcagagataacttgagttatgttgaacataaccgttttccaaatacacactaacaagtataatttccattaatcattttcttttcatttttcttttcagtgtccactcataatatctctatatttaagtaaaaatctagacgtacgaggacgaaaataacattaagatcaagaataaaataacaatcatattactaccgtgattaagattaagattgttagttacaattttatttaattctacgattaaaataacatgttttatttaaaatgcattttactatatttagtggaggcaaatctgatttatttatcaattaattttttaggaatgcaaagattgattagaacgaaccagcaagcaaaatacggacataagacgaattgaatttgtttcttctccctttgtctttccaccttcaccagaagctcctttctctgttcctaagcggagttagagggtcaaattgaaaacgcattcaattgcatcaaacacgtttttgttaatgttgttgcattctcttttcatattgccgtaaacgggtcctgtcctcgcttttctcacaagccactgaatttttttgcacctttcaccccaaaactttaacagaggggcgttgttcacggcaattcctcaccccaatggaaggtattgtgttttcctcttcaactttggccttatcagagatttgggtctttgattttgtggttgatttttctcagattacttcaatttccatcctttgagattggttattggaacccataatatggattttttgtgttaggttgttgtaatggtgggtatggctccaaggtcttcaatttggggtatttggggtctgaaaaagtgagtcaaactgaagggtaccaatggggtttgattaatttttatcataattgaaacttagtttttgatgttttcgtgcatttttctcttccacgttttctttttctatggattggagaagtttttgtttgttctgtcaatgaccatttactgtgtctaggcttggatctactttccatgtggaatgtgtggaattaggattggttgtcattgttcctcgtcttcttgttctttcatacttggtggtgattggcacaaatcgtggttctctgcggaagactctatgaaattataaattctctcaaaattattctttgttcagttgagattagaaaactctaaagaaataaggaacatgtactgatcagtttcatgtaataagctggttgtatcaaacttgtatcatatgacaaatggtatgctagtggttgtgagtcgtggaaaaatcgtggtgggaagatgacacgagtgtatagaattagaatgtattgatatcttagataatgaacagatttttctccagcgactttctaaattttgatttatttggctgtccacttccctgattttttaactgcacaatactcactcttgggattgccgctcccttctgccttatgatggagattggattatgatctaaatatatattatttagtattttaattttgatttcatatttagggtaattagttagtttgtgttatcttttagatttaattataattatcttatgtttaggggtttatctttattttgatggtctatatatagaccctcatagtgtagaccttatgcatgtttttgctatttaataataacaatttctttttagagagtatctagtgttatcaattggatgtaagtagagcttgtattgttgcattgcatttacttagagctaagggacttagtaacttgggaccacaaaattcattagctatgtgttagtaactcttcagtgatcctatggaacaacctcctaacctttggacattgttagtgaaggatactctatagtatccaagcagctcccaagttatgcattctcctttaaatctctttgtttttttttcttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttataattgcaaaatcattttcttgtaaatatttgatctaaacaattcactttttaattcaaatttaaggaaagaaactttctggttcttataattatcaacatttcacatgagcaacttgacttcaattgcccaagcatgcatccttttccatattgtcataactgttcagcacctcagcatatagttgtatcttttgattcaataacatttgtggatcaatttgagaggttaatatgagataagatgttttttgattgttgtcttcttgcatatattactgtaattattttttccattccaacacaacacgtgtactaaacttcctgcatttctgttggtgtttagaatcaagtgaattgcaatcagaagaaaataaagtctccaatgagaaaaataagaaaagaaagttgaaaacaccggcccagcttaaggccttggagaatttttataatggtaagaatgctttttctaaatgggtgttaatgcattttccaaggtggtaatttttgagcaatttcctttttttttttttacctttgtttccagagcacaaataccccacagaggaaatgaaattaatacttgctgaggagttaggattgacagaaaagcaaatatctggatggttttgccacagaaggttaaaagataaaagattgatgaaagatgaagctgttgcaaatgggcgacaagatcgttcaagtggtgtcatccaagatcatggcagtggacttgggcaagattcatgcggaagcagtaagcatgctgatcacaggtatctggatcttaaggaggttgagagccatggcctctacaatcacgaattgtcagttgcagatatgagtcatggatgtaggaaccgttatcctgaaaatgttagcggggtgggtgacacatcatctgagagcagctcatttttgcaagaaaggttgttttctcaaggtcaggatccatatgatatggagccttctagacatcttacacctaatggagctcttccacccctaaatcccaaaggtgcagttaacatgggacacaaaccatcaggatatttgaaagtgaagggcgatatagaacatgctgctataactgctgttaagaagcagttaggaaggcattatctggaagatggtccacaacttggtatagaattcgatccgcttcctccaggggcatttgaatgccaaactgcagatccagctaatggtaggttgcaccatattctattttccaactttttaaatgtctcattcagtttgttttttaatactgaaatgttgttaagtgttgaaattgaaacaatgccatattgggttaaaggaatgtgttgttacacatcaaattgtgaaaaaaaaaaagagtatgaagcattattcttttttttttgtcattggcagtgaatgcttaaagatagaactgggtgtgataggggatgaattgtttatggaacagtaaataagtgttcccaataccaaataacctgcatcatgtttatatgcgattcattgggatgatttagatgcttttacggaatttaagctgatgccttcttagtattgatactaatagggtcaatgacaatcttataagattattttatggtctatattattaagagcacttgtcaaaagagtgtcacttctcataagctagtgttttaaggatctaaggctttggatatgtgtttttagcattagaaccaagaacttaacaaaactacaaggttttgttcctttgtgtagatcattttacttcttttcttttgctgatgtcttgcatttttatttgcttgttttttaaatgcccaacgcacatacattgaagaagttgcggttttgttatccttaaatttggaaagcttattcctaaagactgatgctgccttttatggttcataatgtgtgcagaatgtgctattttacttgtttagttcaagatagttgatttttgctctttgggtgccttactggaaatatttcatcttagctaagttgtgagggttctgtttcgtttcattaactctagaccatttttctaactgcattgagtcattttaagagtagattgagaattgggattcttacctttataatctaatggatgctatggcagaaccatactctgttacaaatcctctgcttccgaattctccagaaatctctgctgcaaaaagacaacccagtcttagctctgtaagtgacctttctaattcatatttcatgagtttagcactgaaatactgtctgtttaaattatatgacgcatgcttcaaagattggacagtgacctaattatttatgttacaagcttatgatgagaattattatttatgttacaaacttaaaactagccctgaagatgtatcagaagattcagaacaaaacccaactttgacttgttgactcccgaattaatttttttttttttgaaaggaaaatagataattttgttaccaagaccaatatcaagcacaagttgcgcccgaattggatgaaccattacaagaaattatccacagtaatgtgctgcttctgtaatgcaattacaaacagaggaaaaaacatatgataaagttgatttatatctgttgtttcccacgttcaccaaataccaccaaatccattccttcaatattttctgtcacactccacaaagccaaaactgcagttacacaaatgactgagatgagtatgataatcaactttatgattccaaaccgagctgaaatttatttccatgttgttcgcttcttttgacatcagtcttgcaactctcaaaatttatatgacattcttttataccattccctacctttaactgacctttgatagcactacaattacctcttgttaccaaaccaaagatcctgtcacccaccccttaccagaattttctttttaatctctctcatttttaagttttggatttcttcaaagtggtaggaaaaggggatgctatcatcttgccatttatattggcttcagaatattatgtagtatagttcaaatatggtacagtgttatggtttaggaatcagtggtaatgagaaagaaatggattggagtggttattcccattacaagtcaccagacagagttggtgtttgttgtagtaggattagaccaaaatggaatgaatggaatagcttattgacaaaaataatcttggatttaaaaaagcaaataataaattttacttttaattttttaacaatataatattatgcaacatgagttgaatgcacacacaatttgtggacagtttttcattttgtttaaatagtttaagataaactttgtcaagactcgacaaaatagcaaaagattcctttcttagtgggaatgagcttattcttggaatgagatttctatcctaaaacaaagaatggtgattccccaagaatgataagtaaaatgtggctaaaatggaatgtttatttttattgagctaaatgtgacccttttacttcttacagatgcttaagaggaaagaaaaaattaagtgctaggggcaacctttccattgttccaagttattctgactgcaagttaaatttttaaatggactagaagctgtgctttgctttataagtattaacagtaattttatacttgtgcttgctcaatcctcatgtaaaatctttgtattgctgttgagcagttttaaacttatcctgtttataaacataacaacattgattatgtgatacaaatttccctgctttctcactctcttttacttgtgtatttgcagagatatgattcatattatactaaatttagttcccaagatctgcatatggaaggagcagactttggttcctcgcatgaaactgattttcaggataaacaagataagaaagcgcaccagaatataaaacgaaggcaacctttatatggttataccggtcattttcctggaaggaactctttcccagatttgtatgaagactctactggagaagcatctgcttataatagcaccaagagtcatagaatgagcactaaacatggtgttgaggggatgcgatctgattctgcttctaaccatagtgatcactatgaagagaagcttgcagttaagcagaaaggcttgatgctgcatgtttatgataatatcaatccaaagaatatacaaaggagtgaacatgtaaaatctaaaccttctagttcaatccgtaattcccgtgttcctatggatactgaagaacgggggttatctgctaggatggcaaaggttcattaatatatttacaccctctgtgtgttatatttgtaatggtcaatttgtcttgcttacagatggtttaaaatgcttaaattttgtgtcaaatgtgcaggaagagatgtttaagggggacaggaaagcaaaaaatacataccgcaatgtagatggagcagggatgctttcaaatgaaatcatggttagttttagatatctaaattttccttttggaatatgattatttgatttccttttgagctcattcccctccttccaagcatgtatatgatgttttgctttactatatgcataggttgcaaaacgagctaaagttgacatgcttcaacaatacaatgtgaaaaaatcacctgttgctgagatggaacaaaggaaaactcagaggtgggtatatatgcatgttttatttttgtctctcatgaccgatcactcaggtcctcaatagaaaaatagatttataaatttatagattgtgtgcatgtttatttaggtagcgtttgacttaacttttttttttttaggttctcttttctttaaaaagagaagttaggccaaacatttttttttttttaaaaagcttttaaatatatgactagtttttttaatgatcctaaacccaaaagacaaagtttatatagaataagctaattagtagagcttttacttttaagaagaaaagaaacctaaaaaagctggggccaaatacaaccttagtagtatttatttttgtgtttagattttttgttttcggatcaatgttgcttgcctcatgaaaatgggataagggttcttctattgcacatatgctaacagtaataattgtgaaggcagtagacagtaatgattgttggaaattaattataattttttgttagcagtaaagatcaaacattcaaacatgtagagttatcaacagtcgtcatgtgtgtttagtttaaaaaagattataatcaaaacactagtaagattttggctaaaaagctttctttgagtaaaagaggatttctaaacaccaggtgtggccgagtgagtaaattgagttccatgtgggtggactttagtatttaaattccccactagaaccaccttttggtcaatgtaaaagcctatagccttgcatggattagtcccacacatcatggtcttacccaatttacaattttctattctatttttccttagaaagttttcaatcaagttgttttgggatatgtatagaggcctcttttctaatggcattttatatgatcatgcagatctgctgcagacttgccttctagctttagcgaggatgaaactgctgacaccagttcctcactggattattaagtgctgttgataaatgctaacaagtgtgtgggatttctctaagccattgtgtatgtacagcctaaaaagacatacattttctctgtaacgtgggaaccattgtttctggcagcaatggcagtgactcgctccatttgctgttttttgttctcacctatttgcctttgtaaaaaaaaaaaaaaaaaaagtacacccggttattttttggatgtaaaatctcatttcctgaagctgttcgtggtaggtttaatgcacagcttatatacttgtcatttgtcttttattggtttaatatggtagtgtgtatggcatcctaatttgctccaatttgatctctttctttggagagatggctacttctactttatgatttaacaattcgtttcatgagttttgtattgtttacccaacactcatatcgatctagtgaggataatattgataagtagttgagattttaacttattagtctcatggcgcatattccccatactaagtgtatttgaattgacggtgataaaattgattttgaataaaattgattccttacttgtgcatatgaaaaaatatctaatggagaggtcaatcccttaaatggatttcagtatctcgaaagattagtctttatctttcggctggggaatactttggttgtaatttttttttatagaattgattattgtagaattgattttggtagaagttatttttatgtgcttttaactttatcatatttttttaatcataattgattttattaggattttgaaaataatccaaacatccaaaaatttggtcaaaataaaggttgaaccacctcaccataatctaccatgattttagaggctatttaaacacactaaattatcattctcgcttaacaataatagaattatttgtaatggaaaaactgatttcttgttactgaacctaaagtaagcaagcctttcttgggagagcttagtccattttattgcgaaggaaaaagacacctaacatatcagggttaggaatcttaatggagaaacttcaggattacatgtgttaccatgttagaggtcccaacaaagtatagagtataaatataggaacttaggaagagctttattttagggcaagatttgcttatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatttgaatttattattattattatttaaatatttattatattattttatcttgtaggacgtgtaatagaatttttcatgttaatttaatttttttaataatcttgtattattttattattcaatatattataaagtatttatttaactaatactttagctggtgcatttcacggtataaatatttattcgatataactaaaatttataataaatacatatttgtaaatatataaattatattataattaaaattggtaattaataaatattttagaatatataattatattttagatttatgataaataatttatattattatataatgttagttttaattattgatactttcttttaaaaaatattgaaatccaagttagaactaaaaatattgaaaatgatagattgaaatagattataggttaaaaatattttctagagacgcttttgttaaagaaaaaatctaaaatattttcgttaaataataaccaaaaacactctctttggaaatagctatttctaatttatatatggaaggattagaaacatgtttatatctcatctctatccttgtgtctccaattttttttatttttttttatgatttcttccttccttcctcattctcctatgattaaaaaaaaagtctcacatgtttcgaaaataatgaatacaaacaaaggaaactgttcctggctaatatacagagaaatctaaccattcaatctcaagttgggacatccttctgccattgattttgaatttggacccttcattttttaatttggttgtgtttttggtctatcataaaaaatataaaaaatcacaattcggaaagacctaccaaccttttgttagggtagtggcccaaggcaacaagactggttgtggttatgcgggtgtgggactgtggatggtgtggtgcatctagaaatctctcctcaatttgcatcttaaattagcacaatccagaggccaattggatgcctaatgctattttattatgtaaaatgtacaaatgtgtatgttgttttgtgtgaattggttcttaccttttggattttttttccatcaatcaccaaatcctagtacaatggatacctgactacgaaactgttaattaaatgatgtatgtagtagttcgtacttcgtaccctgttctttattttagtcataaaaataaaataaggatgaactaaattaatcaatcggcgcagaattggatacctaagaaagcatgtgccgaggagggctttcatcaatcttaacaaataaacatgtgttttctacggttttcgctcattaaaagtttaattagtgtagggtattaaactttctaaacctaacttgtgatgctcttaaattcagttgataaattttatgcccaacccttcttgcatagttgcatattagatgtttagatgttttttaatgcatccaaaaacaggattgttttgaaaatcaaagaagggtacctaaggctaaaatcttgtgtcggattctttttatagggtagcgttttggtaaaactttataatttatcgtgcgtgtacgtgtgaatgcaaatggctaaatcatatcatccattattttttatgaaaaggtatttcatactctttctattgtgtgttactatctaattagttaaggactctacaatttgtacatttatataatttcttacaatcatcaaactaattaaatttgcaaacaaatattaacttctcgtaaaattaatatccaacatcacagtttcaaaaactgaaatgtatcatggatatgccctagagtagattcaagtcaacttcccatactcacagctaagaaaatctaacttgaatatgaattttaacatcatatggcgcagatcctccatagggaattggggattaattatgtatataacaccatactatgaatctgagccgagaacatgaaattacgccaaaagatagtttctcattaataattgtagggcaaggaccacagtgagccacgtagaatggattgaaagagtaacctctcacaatagtcatgcttaaaagaagagcactaatgcaaacattgggtgaatgataggttctctctcccatataggtcaatttgacaaataagcttttaaaaggtttggtcgacttcacaaaataattgcgaactgaaacgttacttcaatttgaagaacatctaactctacattaccccatatttcaaataattagatattaatgtccttccttggttaatagcaccatgtcatgaaaatatagcttaacttatataattatatgctaataaattttattatagtttaaatatcttcagcttttgcttttatctgaacttaatttaattaacttcattttacaaaaatattgagtattgagttttattattgcaaatctcaagagtgttgctttatctttatttttcctttcctggttaagcattcagaatattcttcatgagcaaatgtattatgtataaggatataagtagtgagcagcgttaacaaaatcaagtcgtactatttgattcaacaactaaattggtaaattagttaggtaatagaattattagattaattatacaattgaatcaatgcaaaccgatctgaatcaaatctaaactaggtttaattagtattaggttaaaatgacacgtaccggttttgcaaaatatgtactgcaaatttctataatttataattaagatttaaattaactaataacatgataattagcttatgttacattaaccattacattcataacaattatatgttaataaattcaaaccccttcaacaagtcatatatattcctctacaaacgatagtattactcttcttttggcaaattcaagtgacaaagtgtgtggggtgagtccttacaataaacacgtactctcactttcaaatctctattattatttttggcaaataaaagactcgtttaaaacgcagaagaattttagtgtcactgatatgctagaatatgctagataaattttatttttgattcgcaagtttcaactcatcatcaatttctcataaccgatccttaaaataaatatgttggatcaatccagagctattattatgtttaacatactactgtttgtgacctaacgtgtgaatattcgaaccaaaatcaataaagatgcatatcaaatttagcataggtagtgattcatggatatataaattttacagaggacataaatttgaaaaggaactcttggaagtacaatcttttttgtgcgtgaacttacatgctcatgtaatttgtgtcaatttaatttatctccagccaatgcaacacagcaggagaaacaaagataaatttgtaaactatatattgaattttatcttcatgcgtactttttaaaaacattccaaattctatacatgatttccttttcccacatgatatgaaagtaacgtaactattatgaattccaaggggggattcgatcgagaggaaattaaaggcttttgatatcatgtggtaaagggtgcatctgttccatcaccctacagtgtaaattctgtgaatgtgggactaagagaagttagaaagtgtagggcaattaggaccacttgaggaaaagaataggggaccatgaatttctatgacttgtggctaagggccaacttttccaaaaagtgtaccacactggacagtggtgttggtctcaatcactaacaagggttggaaagacaagtgccattgtcaaagggtatcatgggtgtttgtgaactccagccatggtgcacatgcatggattgattaatttgaagttagttttttacacacactcacccaatggaattgatgggtttttgcatgtccccatttgctagatcttttttattttgttacatcactttacttgattgtgtgtggagtttaataacttcacacacatcaacctcatgaaacaagctagggtgaaagcaacccacaaagttaattaattttaaaaaataatacaaacaaggtgagtgaggcttatgataagaacccgctcacgtactgcgctttcagtgcctaattattgccatagctgcagcctgcagtgtgctggatacagcttaatagatggttcggttaaatcttatgtattaacatattaacgttaatgtcgtctctaaataaacctaaagctaattttaagatggattttaaaaaaattaaaaaaattagaattttatccaaaatttaaactattttggtaaacatgggatatctagtcataatgagagaattctcttaaaggagccaatctctcttgagagatatttttttatatacacaaacttagaaattatacttttaatcacatgcttaagggtcactaattatttcaaagacaaatgaaatatttgaaaggtttgttgaatttcttataagattcatacaattagaatgagagtgtctaaactatgaaatattattgtattgacataattttgcttgattgaagtaacaatttgttgtaataaaataaatagaacaagaacaaattctccatagatgaatccattttatgaggaatgacaaaagtttgttttccctattagaccaaactttccttttgaaaacaatgttttctctattgcaatagtcaacctagaaagattaaaatagcttttgctcatgttattttaacaatatttatagtgatttgtgttttttttattttcaacaaaaaataagaattgctcaagaggttgattattttcattttcatcgaccacgacttgcatggcttttattcctaaattcataaatggttaatgagggttattaagtagggacaaaggtttgagtcaggagggtgatttgcgtggtatgcatatgtagcgtcaatcatatatcgatgaaaatagtattaactaccaattgtcgacacaactaatgacaaactgaatgcatattttaatagtgttactttagagtttgccatgtggtcactacacataatgttgaccacttttgaaggaagttttaaaggtagctttgatttttttttttttttttggaaaatatgtaaattttatatattaaccaaaaatgatttacaagtactcagggcatcccctggcgaaacacaaaaagaggctaccaaaagccacaatccaccaaaaagtgaaatacaagtactcaggacattccctggctagtcaaagaaaaaaaggttacctaaatacatcagaaaaccacattaaggatttacaagtactcagggcatcccctggccaaacaaaataaaaagatgcagtctatagacatcacttgtcaaaagaagcaaatgtacaacccatcaaaagctgaaatacaaaaagcaaaaacatttgttaatacaagtgagtcagatgagcatgaatcctaaatttaattctatctaccagatctgtcatattaaaaacatgttggtcaaagagaaatggtgttcctgcagctccaaatttttaaaccaatgtcatgttgcgtcaacaatgatgcaaacccaactattttgcgttgagctttgtaacgtttgatttgttgaagaatcgatgcaaaatttgacgctcagtgtgatttttcgttttgcgtcgacttttgcaatttagagttacatttgactaatgttaaatcataaatttcttgtaatgttagatgaagagtaatgttgatatttataagtataagatgggggtactaagtttaagattatgatacctagctatgccaagcaatattttaagtgtagtttaggttctgactagctagaaaaccaaggaaccaattaatgactatgatctctaaaacaacgatggttagagagtattttacagatctttctctaaaattgtgacgatatttttttaaaatattttatgtgttttattaacttcacttatttcatctatacgtttttaaactttcatatttttaccatcgatcttaatctttttattttttaacaaattcaaaatacaatatataaaatgtaataaagtaaaaagaaataaacatattttatcatacacaatttatttattttattaaagcggtaatatttttggagggagttaaaaatataagtttagaaattctttgtataggtcaaccttaggaattgtttctcaaccacataaacaaaaacaataacatattgaaacatctcaatgcgttgacaaaaagaaatcaaaagtgattctcaaatagttacgacaaacaacatggaagcataataaaattttgaaatgggattgtggaaaagctatacaagcattgtattgctaatgacaattaaatggagagagtccagtaaccaagagttgatatgtgatgaatggtgcaatggtggaatagttacaagaggaaaacatgaagaagaagaactactaacacatgtgtacacccaagtctaggtaatttaagtaatggcagaagtccaaaataagactgtaacattaataatgggttgattaaggaagctactaacgtcctaacaaactgaagtcttcatatgataattgtcactaatatagacccaagtctaggtaaattattcatgataaattaggatgaagtttgagcgaaattaagtgattataaaaaattaacaaatgagtttgtagagcccaaacataattagtgagacaatgagagattaaaaagaaaagggactcaagcgaactatagatgcacttgaagcaagacattttattgctctgatctatttattgtttgtcatgtcagcaatctacttagaaaaattaaaaattattattaatttaagaaacaacaatgatccacaatgctgacatggcaaacaatgaatggatcagagcaacaaaaatgtcttattccaaatacatctaagaatttctcgtcattatatattacttcaaccgtggataaataactgtaataaaatgctacatttttttatagtggtcactgttctgtacgttgagaagggaataaaataattcgaataactgattaagggtcttatatgcctgctattatgatgaagaaagtaggaatgtaaagacaggtaagaattttaactagaaataactacatttaagagagtacatatttaaactttttttaattttataataataagaatatagtaaaaaatgatggtcatttatttttaatctatggagggggacctttttatccaaatcaagaagtaaattagtcaattaccaaaaaaaaaaaggaattgaattagtcaaggtgcggacaaattgattggttctatagaatttttaaagcaccatcacgataaggatgaaaagtattaaaaaatataacatctttacatttttcttcattaatttaagtaattttcatctgtcacaccaaaagtgagacttgggttttcgaattgatagttgcatctcagtatctcagatagatgatgatgtattaagtgtttcagtcttcagaggatttcatagtaaaaactaaaaatgttattcagatgatggataaagggcggatgaacaccggtgaattgaatagtaataataatttagttataataataatttctcttattttagtcagaagtatttaattaaccaacacgattatttttaaattttctttttaataaataactatatcaacttttctcgaaactagcaatttttatacatttctcgaaactagcattagttacacttattaacgtatatctattttacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatcatagaatgaataataaaatagaatctatttaagtagagtaatactgtggattttgaattaaataatattatttaatatttaaaaaaatatatgagattatcatgtcacattatttcttagaattcaaccttttttttatacataatatatattagatttttttcttcttatagcaattataattgggacagatgaataataaatttaggagaatgcaagagaggtaagtataatttttttaaatgaagaggtgcaaaggtaattgattctaacttaaaggaaaacaaacgtaaatatttatattttaaggtaatttttttaatccaatttcaataatttatattctaaaaatcattttctttaattttttagttcttattttcttcttaaattatacaccttttataatttaaatatttttaactttaaaaatattattggcatctcttacaaaatataaaaaataaaatcattttaatattacagtctgctccatatatagaaaaaggaataatcctgaaataatctcatctttagtcaccgccacccaaccaggacaaagcgattccggcattttcggcactgcaattatatacacatgtataattctaaagctacctttttttattcttcattttttaaattctctttttaaataattgtgctttgtttttatcagtaataaataataatactcatagtattgactcaagtcaaccatgaccagtttatccttttttttaaaatatttatttattactcaaatctgtccgtttctttttaaacgtttttcctgatgcctgtaatcaaccaaaagaatttagtttaatcagaacacataacgtaaaaaccaataataaataaataaaagcgtagcgtaggggcaaaatcgtaaattttgacgacaattagggcgattcctgtgtccgtttcacttttcttaattaaaaaaaaaaaagaatttagcttgcttctgttttgagctctctctcacactcactcactcctcagccatagagacgacactgtgtttcttttttatgctttttttgtaattccattccgctttctctctctaaaacctcactttctcgctctctctctctctcccctctgcaactgattttccagatcatacttcctagattctcccattccgtttttccggcacttcctcgccgcgccgccgcgagctcgccgacccctccaccaccggaatccgcggagcatcgccaccgcaacctcgatcgcttccttcttccgcaacctagcacctcgtgccggtgccaatcgctgcttcggagcacgctggagcagttcccgcgccgcatgaagcagtggagcagcgctctagttcggtgagtgcccgacggaggcgtaattatggtggattcgcgcgccggaaaaggctcggagctgttggagcgagggtttgagtgtgcgaattgatgaatggaagggttcgggtatgagaacgggtgaatgtgaaagattagtgtttagatttgaggagagagtgaaagtttctaattagtgctattcgtgttttttttttttttttgcgtgatgtcgctgactagtagaatggcttcggatcttagcagaaccggtcctgtggaaagagacattgagcaggtgtatatctatctatctatcttttttttgtccatttctttggtagctttttctctgtagcgtcgtgcttcgaatttcatgctggagtactgtttgtttttagattttgtgtatctgattggtgtgcgtgcgctgtacagtggtggtaatgttcttatttgttgttgttgggggcattgggaataggtaattggcttaatttagctaggagcttaaaattttggatggaagtctagttgcaatgttttggttcgttagtttgactgccagctaggattgtattatcatcaggtcaagctagtttatgattggcagtgaaaaatcttggtgattttgagctgttgcttaggaaattttcttataattaaaatttacttaatgagtttgtttatacgtagttaagtatgtgttgtgacttctgaatgttgttcgaagatttggatgcttttttagtggactaaacattttaggtatttgactatgtgaatattagattatttttttcttgaatttatgtttcactaatttgaccatttggagatctttctatttaattatcgttctcttttatggattgtttgggtgttagataccatgttttgccacaggaatacaaggcaaatgcattatgctgttactattatattgactaatagacagtatgttgaatttttggactttagtagctgttcttggtgcttgtcagttgaatgttatccatgaactgtgcttattcattgattcctataatatgttataagttttctttatcttcagatgtgttatatatgctggctgaagtcttttattgatcttatcgacaggccattactgctttaaagaaaggggcctgcttgctcaagtatggaagaaggggaacgcccaagttttgccccttccgtctttccaatgtgagttttgtactctttatctgtagattcaaattaatccttgttaaagtgtgtgtgtgtgtttgtgtgagttttaaatacttatatttggcattaataactttgtccccgtatagtttcaaaacgaagctcaaacccttgatttttctacattttattttgtatttatttattcttaaatagtggtgaaaatatttcttttaatggatggtagggtaggggaccttgaagttgaatgacatagtgaggaagaggagagcgaaaatgtgaagtacttgttaaacaaattaaactgtgaaaattaagagatctaaaatcttcatggtctactagaaaaattacaaatattacggaaagattaatcaattgcttaacatcaattaggattgccttaagattaggttttcaaaggtgtttgcactaacaacatattgaaaatttgataaagtcacgataattatggcattgagcttagcatgaattttcagcaacaaattgaaaatgtgaaaacttgattttgcttttagtaaaccattgtaagtgggcagccctgactagtttacagggaaaatttactagtgtatggttggatacaaccctcccgcatgagaatgatttgatctgcttaagacacccattgtgccaatattaaaaaatgggaaacttgcctttgaaaaacttaccaaatcttgttaaagcaagcattctaatccacatatctagaaggtatatttgaaggtaagcatgcatgttaccttattattgaccaccacaccatatcaaacacttttgtatttggttatgattatgcatgccatttatggaatcactttcatgtcatttcatggtttgaaagccatttgattatcttattattcccctaatcttgcttctggtttatttatattattttcataatttgaagtttgtttttagatgttttccagttgccaaaaaaataagatttggcttctctactttttcaggatgaatctgttttgatatggttctcagggaaagaagagaagcaccttaaactgagtcatgtctctagaattatatctgggcaacgcacagtaagttttagactgacagtgcaaagtcacgatactgttttgcttcttcagatttagccaacagtgccttatcatgttgagataactagttatgacagttctgttaaatttgatgtttgtatgaataatacagttcgtgtcacctttctctatatgcacttgtgatgtgagtgtgaccaccatgtgctggaagtcaagatatgtaaatatcatttatttcattatccatctacagtaaaaggatttgtttctttagtattatgaatagtttacaatatgcttgtttgtggtaactattagattatgttttgctttgagaaacatgatgttgtgtgctgtttcagtgtcctagtctaataagttgacatttatctaaaaaaccattactcatgctttcttgactttcagcatctacagtgaattcatttcaagtgattaggttctctgttatgattgataaaacatggctcctacttttttcagcctatctttcaaagatatccacgacctgagaaagaataccagtcattttctcttatctacaatgataggtcactggacttggtatgaattttcttcattcctctcctcttggattttttagctgcagttggcccgttgctttgcttgtacagatgttattgatattgtgaacagtatcaatgtatttgtatgcagaagtttaacacaatctggtggtctgattctttttctactagatatgcaaggataaagatgaagctgaagtttggttcagtggtttgaaagcattaatttctcgtagccatcaccggaagtggagaacagagtcaagaagtgatggtattccatctgaggctaatagtcctcggacatacaccagaagaagttctcccttgaattctccctttggcagtaatgaaagcctgcaaaaggtataaacttattctttatgtcccttctattttctccatttttctctacattgcagttgaatatgtttattaagataatatttatttgtcctattcaggacagtggggatcacctttgccttcatagtccatacgagagcccccctaagaatggtttggataaagcattagatgtggttttgtatgctgtccctcagaagggtttcttccctccagattctgccagtgcttcagtacattctgtgtcatctggaggatcagacagtatgcatggtcacatgaagacaatgggtatggatgcttttagagttagtctatcaagtgctgttagcacatctagccaaggctctggtcatgatgatggtgatgctctaggggatgttttcatttggggggaaggcacaggtgatggtgttttgggtggtgggaatcaccgagttgggagttgtttgggtgtaaaaatggatgctctatttcccaaagctttggaatctgcagtagttcttgatgtacagaatatagcttgtggtggacgacatgcggccctagtgaccaaacaaggtgaaattttctcctggggggaagaatcaggcggcagacttgggcatggtgttgactctgatgttctccatccaaagcttatagaagctctaagtaatacaaatattgaacttgtagcttgtggggaatatcatacgtgtgctgttacactttctggtgatctttatacatggggtaatggcacatacaattatggccttctaggacatggaaatcaagtgagccactgggtaccaaaaagagtaaacggccccttggaaggcatacacgtgtcatatatttcttgtggaccatggcacactgctgttgtaacatctgctggtcaattatttacttttggtgatggtacatttggtgctttgggtcatggggaccgaaaaagtgtttcattaccaagggaagtagagtctctcaagggtcttcgtactgtgcgggctgcatgtggtgtttggcatactgctgcagtcgtggaagtcatggttggaaattcaagttccagcaactgctcttcggggaagctgtttacttggggtgatggagacaaaggtcgacttgggcatggtgataaggaagcaaaacttgttccaacctgtgttgcccttgttgaacccaatttttgtcaagttgcttgtggacatagtctcactgttgcacttactacctctggccatgtctatacaatgggtagtcctgtctatggccagttaggaaatcctcaagctgatgggaagctaccaatccgtgttgaagggaaattatcaaagagttttgtggaggagatagcttgtggtgcatatcatgttgctgttttaacttcaaggactgaagtttacacttggggcaagggtgcaaatggccgtttaggtcatggcgatgcagacgatagaaataccccaacattagtagaagctctgaaagacaaagatgtcaaaagtattgcttgtggaactactttcactgcagctatttgtttgcataagtgggtatctggtgttgaccagtctatgtgttcaggctgtcgtatgccatttaatttcaaaagaaaacgccacaattgttataattgtggacttgttttttgtcattcatgtagcagtaaaaagtctctcaaggcttcaatggcaccaaaccccaacaaaccttatcgtgtctgtgataattgtcttaataaacttaggaaaaccgtagaaattgatgcttcatctcattcttctgtgagcagaagaggaagtgtcaatcaggggcctctggagttaattgataaggatgataaattggatttcagatctcgtaatcaacttgccaggttttcttcaatggaatccttcaaacaagtggaaagcagatcttcgaagaaaaacaagaaattggaattcaacagcagccgtgtctcgcccgttccaaatgggggttcacaatggggagcattgaatatttctaaatcttttaatcctgtttttggatcatcgaagaaatttttctctgcttctgttcctggatctagaattgtttcccgagcaacatccccaatatctagacggcctagtccacctcgttcaactacaccaaccccaacacttggaggtcttgcatcccccaagatagttgtggatgatgctaagaggactaacgatagcctcagtcaggaggttattaaattaagatcacaggtatcttactttatgcattcgtcaacagtattcactttcttgctgtaaatggtttgaatagaaatttaacaaaatggccttgtatggtaccatatttttttattacaactggtcattttttatgatgttaatttatgtgaattatgtctgatgaaatgagctatagacactgtggaaatgaaggcaagaagggagtcatatgcttattatgatagtttatactctatactattatgcttggatgtagatagcaagatgcatattcattgcaagtcagtgagttgctcaattatttgctgtattgtatgataataatatagagatgaattgcaatttaaaatccaggtcatcataaagttaccatatgtgtgctagagatgaggtatttccatgtaaatttaaatatattattgcaatgcagaacatgtggcaagtcactgttgaaggtagtcagggtttgtgatttatacttctatctcataataaaatattaacaataacagtgagtagatttttattttgacactgcacttttttctttaccattgtgttttggagggttcaatgaatcaattttaaagaggttatactgttaacaattcatttttttcctaagtagtttttttcccttgtaggtggaaaacctgactcggaaggcccaacttcaagaagttgagttggaaagaacagctaaacagctaaaagatgcaatagcaattgccggggaagaaactgccaaatgtaaagcagcaaaggaagtaataaagtcacttactgcccaggtagaaactttaatcccttaaactactttaacaaattagactattatagccaaaactcttaatcatgaagaaagcaaaaaagagcaaaaaactttacatgtaatgggtggagccttttctttttctttttgaaacaaatcaactgttatgtccaagaaatttttcttagctatagcaatatagtcaaggttgtcttaattactaattgaccctgaaaataaatagtaaagccatgaaatgttacacttaaagtcatgcccgatatcaatttgatgcctaacatagtagattttttttttaatcttttaagcttatataaggtatgttcttgatttgtactcgatgtatcttaactaggccaactgatccaacgtttatttgttacttgtgctgagtagttgaaggacatggctgagaggttacctgtaggagctgctaggactgtgaaatcaccgactcttgcttcttcttttggttccaatccttgttccaatgacgttatctatgcttccattgatcggttaaatattcaagcttcaagcccagaggcagatttaactggatcaaattaccagttacattcaaatggatcaagcactgtcagtagccgtagcacaggacacactaaacagagccagtcagattcaacaaatagaaatgggagcagaactaaggacagtgaatcccgtaatgaaactgaatgggttgaacaagatgaacctggtgtatatatcacactcacctcccttccgggaggtataatagatcttaagagagttcgcttcaggtatgcaatgctctgtagactttgtttctctgtcagaacttcatctgtgatatttgttaatgtagaatatgatatacttccatagaagaaaaagtagaatataacatggtgttaatgccttgacaaaaattattcctacgtcaatgacacattttgattctaatggcaatttggttgcatgttcttatgtttcatgtctaggacagttgcatatttcctctatttgaattttgaaagtagaaagtaatttcccaccgtaatgtttatagttttgtatctggtgggacaattcagataactacacactatttcacgattaacaattttgtaaccttaatgttggtgattgcagtcggaagcggttcagtgagaagcaagcagagcaatggtgggccgagaatcgcggaagagtctacgaacagtacaatgtgcgcatgattgacaagtcttctgttggtgttgggagtgaagacctggctcattgacatgacaacctgtaaatgagatgtttttcgacattttggctgggattagggcaagatcgaactgatcaattacatttggcttccatctagtataaaagcgacgagggaagcttagggggattggcatagtaggagagaaaatagggattgattgtgattttgtaattcctcttcgttttcttctttaattttccactttgatttcactttccatttttttccctatatgatgtaccttgtgtgggggttgagggtgagaaatgtaaattcttagtaggttgcaagctctgcttgaaaggagctgcagtgtaaatttcataagcgaatgcatttgcaaatttttcttctacacgggatataaattccctcagccatgggaaaaacggctctaagtagttaaatatacatggccctgccaattgcatatttcatatttgtattctttttttcctgctcttgcacttgtacttgtagtaagtaataccgagttggggacatatctaacgactaacgagcagagaccctagcggcctgcgccactttatttattaatcttaacaccgttgcattttaattgatataggagttatttatattttaaatttcatattatatgttgaagtaaaaaagtgctatgaaacattagttaatttttaaataccttcgtgtgtttggatgggggggatttgatagggtaattcaattttttaaagattgcttctttgtaaaataaggtgtttggataaagaatttaagaataattttcgattttagtattttaataaactaaaatcttaggatttcaaattccttcaaaaatttaagaaattgaaattcttgatgcagactcgttctcggtatgctttgcttctctcacgttgcacgcatgctctcatcgcaaggctctttatgttgtagagtaggatataatgcctcatgttacgcccttgttcgatatcgatgcctattggttttatgtttatggactaaacgatgtttcttggtgattttgaattaaatagatgagatttctatgtttggatggattcgtctatgtttttctgaatgcaagtggtgttgtgtgtaagaatggttcttggtggccctacaggtacaattgtagtattaagcctccacaaaagggttggcaccatgaatatgaaaattcatgttgtttcataaagttttggaatgctgacagaacataccaaaaactggttctgcctttgttaccctttaatggtcattgatattgatcccaatacatatacatccaacattttcttttcttagctatctacataaaatgttgcagttgaaattttagatgcatgtccaaaattcaagtttgcgatgagatgtgagcgtaatagatgcatgtccaaaattcatgtttgcaactagatgttaaaaaaatatgaattgatttgtgatgggggtgcctgattttgtaacaagcagccacaagggtttttggatcattgtggtgtgctgtaaggaggagaatatactttaggcactactctatttgttgaagattttaagtggaaatgaaaaaaataaaataaagggtgcgaagttgggttttctggaacaagtgttgtaggattaatttcatgatatatttatgatgcctattcatataatgaataacttgtccagtacttaattgctatttcaattcaggataccaatttaatcattcaacatatgttttctgtgagggttaagaaaaaacttatttatcttcaccacagaattgtatatgcttttctgttttcataaaattgtctcatgcctatgattttctcgtttacttttatccttccaatgaatatggtccttgcacttgacttcttacataattttaattcttcctattacataattttactaatctttaagaacatgcacttaggatatataactagctgctacatgtatctagcttcaacagctagaatagatatgtaactcattttataaactcttgtacataactactggatttgattgatgtaatctatcttttcagcttaagtgagcacactacccctataactttccctgatataatatgattgatcatgataaaaaagatgtggaagattaattattaatgatgtatcattgattttatctttttccatgataccaatgactaattattatcaatgtctgtcatggcttagaccaagtcttttattggtttggcaatattgtatcacataaatttacagttttaacaaaactatcaaattaatatttgttgataaaaaaaaaaaatgacatcatgccaacagaagctaattattactttactttcactagatttttaaacactttagcactcagtaagtgatacgtatggactgataccaaatgtatagtaattgaaatttgaaagattttaaatggtaaagcagtgctaaagataggattgttgaagatagagtagatattttatctagttgtaattggagttggataaataatcatggctacatgttttatctagttgaaaattggaattaactatttgactccaaatcaagggttagactttaatttgttgagtgagaggttagtgtgatactaatgagtacataggcgtgcagatagtgttttttgaaaagaaaaagctgagcgtgagagaagacgagattggttgtatagagaagagagcatgcgatgctattagtggtttcctgaattcgcatataggcagtattgtgcttggatatatatggaaattaagatgcatagacagagacaaataaaacctgcaagttgtaaccgctaaggacttggaacgaaaaaataataatatatttaatgtgaaaattataagaaagtggaaaaaaaatcatggatagtaaaatttattgtctcccaaaaaaattattttgacttttaaattttaagttccttaaggtatgagtgttattagacttgatttttttaagaaaaatttcatgttcaagtggatgaataaaaatgtaatttaaagagaaaaactcattaaagataatcgaccaatttttttaacaaagattaataaaaaaaatccatgaatatatactccataaaacaatagattccttaactattgtctttaggttactaattaacatttaccatattgtattatcaacttcttacatgcatttttttaggggtcactttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaacgtagttatagtaaaattcaataaaaatacagattatatattataatatatttttagttcttttaaaataagtaaattttgattttgatcatggattttttattttaaaatttaaaatatttttgttcatgtaaaatgagaaaatttcaatttcgatctttgtataatattttttttttaattttcattcctccaaaatctgagaccactatatttaatatctaaattaacatttgagtgcataaagaatatttattttagatttttaaaaaaattagaagagtcacgtgcccacataatatcataaacaactagtgtgtgttatcgggaacgataaattgactttctgttgaaaacataaactgttaatgaatacaaaggtaaaaataatgattttatatctttttgatagaaaatgaattcatatctttaagggataaaaaattaaaaaaaaaaactgatgtattttatgcatagttttaaaatctggaccgacctatcgaatcggaatttggtgattaaatcgggtcgagtaataagtttgatcggttatgtttttgacctgaaataatcgattgacttagtcgggtttgtggtcgaaccggtgacccgttggtccatatcgggttacttatcttcttcttttttcatttttttactttttttttattttgagttaaattgataaatcatttattgttgaatattttttgtggctacaattgcatttttgtttagttaaattaatttagaagtgactgtaattgtggttgagttataggtgaaattgtaatcacaaatcattttttaaaaatgtcatttagaactttagattgatttttttatattttataatttacattgatatgatacggttatgttttattttagtgtaaatgtttatatatacttccattgatgcctttaatgttaaatgttagagataatagtcattttttaatttgtatttttatattttatttgtgcttttaagatttttgaatttgaatgtattagaagaaagattttaagatagatataaaaaatttatattttttttattataaatcagatcatacaggttaattagtgatctaccgattcgaccactaactcaataatccaatactataattagatcagtaatcggatcgattttttaaaattatgattttacgttaactaaaattatatttaagtttttttaataagtgtccattgatcttgtatcttcgtacttttctttaattttgaatcaacaaaggagtacataaaatagaaaaatcacattttttattcatcacaatattttttcaatttatgtggtgctataaaagtataaaaacgtaattatatcaaataatctttatatatttagaatatattacaatgtactcaataaagaacaaaatagcataatttaatgaacggtgaataaagatatattgatgttaattcaatgaacgtttagataagatcataagaatatgtctttaatgaattaattaaaactgggagggtgcagtggttggatttttggggtctatagcaatacctgacaacctaaaagctgtgtgctgctgttcagttggtgtccgaatggcttttgcttcaacacacaaaaaaaaaagtaaatatttctttgctctcgattgatctcaattaaaaattttaagtttttttcaccttacttttttattcttgattggaacttagtataaaaataaaaatgagtcattgaaattaaaatcttgataaaatgaaaggtattgtaaaaacagtaacatggaaggaagtaaaaagttacttaaaaaaaaaatctgaaatcaggaaaaacatttttttcttcttgtatttgagaaatgaggaagtaggagctttggtaaatgtggaaatcttatcttaagcacacttcaggaatacaaagtggacaaagaaaatgcagagagtgatggatcaatggtcagtcttcatagtaaaagcacccatgacaggtctataattttgtaaaacactcactttaaaaattaattttgtaaaataattcattttggtaaaaaaaaatcctcatcagcacttcttttattcatcatcatcacattcaacaggttttttcagctttttttactcaatataaatctagctagctatctcaattttatgtaaatagtacaaagtaaaaatcagttacacaaatactgtaagttgataacttattaggggtatgaatgtgttaaaacttaaaagcaactttatacaagtggccgagttgaaaattaaagacagtaacacatattcgccaattaagctagtttaggtctttgatcgacttgtcttttggaagattcattgtgtggaatgctgtactgaacacgttcatttccataactgaacatgcatatgtatatattttcatttgttttgaaattatatttttaataaaataaatttttgtaagagctctttattttcgatttagtgaaaaatttcacaaatttagataaacttattatagcgtaccaattaaaattatagtgaaaatattaataataaaaaagctactttgaaggggggaattagtatattttgttcttgtttactatattttgattaataactttaataatggtgttgcgattatattttaactaagctaagataacaaagttaaattacatttttgggaaatattaaatatttaaaattttattttatgaaaatttagaaaatatttaatgtgtgtgaaaataattagttagatgattaaattaagacaaatattggtgaaggaactaaaaataatttttaattaaaatacataaagttgtgttatcattcataatttttttcttgtgctgtactataaattttataataaacatttctattttattttttaaatttcttaactaataactaacaattctcttaaattaaataactaggtggagcgcatgttgctaaaagctgtattttaattagggttagatggtatccgacggttgacagcgtttgagtattcttgatcgctagattaagctgagtggggagcttcaatttaatactcttgtagtatattatatatatgcttcttcaccaaccgttttttatcttctgtataaataaaacaaacgttttgtctcttttatcagccttgctcaaaattctatttcttcttcatttccctcgaaaatccaaggtatgtttgttggaagttaggcctcattatattgtgcatacatttatatgttgtttgaaatttgggattattgggggatgaactattctgattaatgttttgtttgatggttgttccgtcatcttgctttggcattgctattggattaaattttctgctcttgtttgttctgtgggctgtggtcaacgatgcatgtttcatcactgtttcggaaggaaatcgtataatgaacaatttgtatgcgcccttatatatgctctaaagtaaaattttcttaaatgcagattttttcagcctaattagaggtttggagtttgaattcctgatatatgcaattgcactatataatctattgagagagaaatttatccgatttgatcaggattgtctggagcaggtgaacaaatggcagagcatagagaacataaggttgttgataaatctcaggtagctccagctacaagtagaaccatgtcatttcctctatcattccttgacttgccttatgcacgtcctatttatgtgaaacgcctattcttctatcactttccccatcccaaacacattttctatgaaactatactcccttctctcaaacacaacctctctcttacccttcaacatttcttccctctcgctgggaatctcctgtgtccaccacaacctcacaaacccttcattcgctgcaccgatgatgactctgtcaccttaaccatcgtcgagtccaaagcatatttcaaccatctctcatccaaccaccccaaaaatctcaaagatttggatcacttagttcccatgttgacattcacaaccgtgcatggtgatgatgatgaggaggacacgtatgtttccccgttggtggccttgcaagtcacggttttccccaaccatggcctttgcatcgccataacaaattctcacgtgatcatggatggaaggagtagctgttatttcatcaagtattggtcaagcatttgtagaagtggtggagttgacttgacacccccttgctttgatagggaactgttgaaggacaccaagggacttgaggccatcttcttaagagactactttgaagagaggtcaacttggaaggacaaactcaaactcattggtcaaactcctaatcatgatgaggactatgttaaggcaacagtttcctttggaagagatgatattgagggaatgaaaagatgggtgctgaaatcagttggaaaaaaatgatgaattgatgaaagcacccgaatatctatcaaagttcgtggttacatgtggtttcatgtgggctagctgggttaaagcaaaatgtagacatgatgataataatgatgaagatgaacaagagatcatgaaagaggagtactttcgttttgcagcagattgtagagaccgctttgagtatccaataccagcaacatactttggaaattgcttaacaagatgtcatgcattgctcaagagaaaggagctaaagggagaagctggttttgtgaaggcagtgaagggcattgcaagggcaataactgatatgaaagctgaacctcttaaagatgcagaaaactggaaggaattaagtaggaagatgtttgtattgggaagtacaatgctagttggagggtcacctaaatttgatgtttatgagactgactttggatttggaaaacctaccaaagtggagatgatggtacatccccaaatattgtgtgtgtctcttgccgaaagtggagacggagaaggagggatagagtttggcttggaatttacaagtattggggaatttgagtattttagttccgtcattgagcaaggacttgtaacattaaaatcctaaatgattgcatcattgcatgtggtccttgtttccttttctgctctcattaattcagtcactctgtaatgtaaaaacaatatggagtattactactttttcattaaagttggaataaatatatcttttttttcatctcattttgagactaaatccgacacgatcagagttattttttagtcgaggttgatcataattattttgtctgaaattggctgaagcaattttttttttttttgcaaaagtttattaggattttttccagcagatattgattagggttatttttttagctatgcatctaaaaattttcgatccacgttcgtggagattgttttttggttaatattgactgaagttggttaaaattattttttggccaaacattaacataggttatttttttgccaactttaactaaattttttgaccatcatcatctaatgatgttttttaatcaacatcgattaaggttgttttctggctaacatcttctagagttttcttttattgatattgatcaaagctatcttattgctaatattggctaggattttttcagccaatgtcaacaaaacttttttttgggcaaaagctatcttgtagagtgatggacataatttaatttattaaaagaagaaaataaagtaatttaatttatataattaaataagtatatatatatatatatatactccctcttatctcaaatataagaaaaatattcttttcttgatttcaaataaaaaaaaatcaattaattttacattatttaatgttagtatctctaaaatatcctttatttaattgaggtattagttttagtgatttttctctattttagatatcaagttccaataaaaattaagttaaaaaatatttattaaaattagtataattaaatataattaactaattttattcattcttacctcatctctttacttcaaatcatgtgatcccttgaattaacagtttgatgataaataaaatgagttaaatgtgttttagtaaaagaaaaaaattaatgagtgtgaataagttttttcttcttatatttaaagttagtgagggagtatatatatatatatatatatatatgaaggggtaaaatgtttattaggaattaaatgggaagaaggcaagttggtaattttgaaattgcgtgaagggctgtgttgtccaaaatacctcaaatatataaacgatatgaccgtagcgggcttccacgaaaaattcaaaatccaacgaacggtaacgttttcggtcttcttcttcttttccttccgcatctcgttatcattcatcttcggtgttctctactcgcggtctttacttttaacctttctgcgatttcgggtttgttatattgcttctgtttgctttttgttatatttctgaattctatttatttaatgtttttgaattaggatttatgttctttaaagttagtgtacttgattgattgatacgtggaattgggaaatatatgagtaaacggcactttcctagaaaccttatgggattttgctatggaaaagaaaatattagcactagcaaaggtttttcttcctcgtgatgttcataaccttcttttttttttggtttttgttttttattcacactaatattttaatttgttttgcagagtccagtatcaaagtctttgctctctgaaaaaagtgaaataggataatggctaagtttgttgctcctggccacctgattatcaaagatgaaaacttgaatcttcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactttgcattctgtaacagtattggtggttactgcactcttctcttactgtgttagttttgtttgccctttgtgtttgctcgggacagagactactaagtcgaagaattctaagacaaatggaaaaaaagatggttcagggattgcaggtcgaaaagctctaaatgatataacaaacaaaagttcacttcaccaccctgaagcctcggttaagaaaagaaatttacccaaggaagatattaatgtaaaggaggaaatgttcttgcatgatcacaagaaatgcattgaggctcaaaatgctactatgagaaatttcaatcttgagaaagttcttccacaagatggtatggcttttacttcagtattcgatgtatggcatgagttgtgaaaatctttatggtgcaattaaatcagtttcttagtttaccacaagatgattactttataattttgacatcaattaaatcaatgtcgtagtttttaactttacagttacaacttacaagtaaaatgtggtattgaatattatgatgagattgtgcatgtgatatattggcatgtgagtgagttcttgagtaacttatttctagcaatctttattagaatacaatgaagagagaattgacatttggcattgaagttggcattagtaacttttgacaaaagggatttcttgtgagatgatttgatttaaaatatatctgaacatattcctattcaatgttttggtgaattaaatttggatgtccctgactatcatgttgatggttattattattagataatgttgataaaattcctaacaacattttatctctgcagattccatatctatcctagagctgataaaggtaatgatgtatctttctgaccccttttttagtttgttttggttacatgtatttgaagctgaggggtgctttgaggacaaccactgaatatgtactatttcattttgtcatatacaatgaaaataacatgctttaagatgatttaaatcttgattaaagcatttaataatcaatccactacaagctgatatcaatttttaagcattttgttgattagaaactttttactgttgcttcccctttgtctaacatttgctttatcatctgttttcctttttcttgtggcgttaggttcctgattcccctcaatgctacccagaaccagttgaattgccaatgtccaaattttcagattggtttgaccattcaatgcattggagctcccctccatcttctccgttgtcatgggactctccaccatctccccttgcatggcaaaatgaagcagttgaatttgttttgaaggaagaaattgctgtccaagtgtaacctactatttcttttgtcgtgtaacagaacaagtgaatcccaccgttgattgagccttgttttttggtttctttctctgtatcgcttcataatcctagtcccttcagttgaatgaatttctagtttttgtcaaaattaaacatcagatctagtgcacgagcaatgtggaacaggtaatgtagtgatgagttagtgcatcttatgcattaaacttccagcgctaaagaaaagaccaaaaaaatggtagcaattccaattgtattctgtctaataagacattttctgaagcctggtaactgcatatcaaataatcagtataccatgatatatgctgattatttcataattcaccaaaaaaaatcagtaaattagaatgctgcaaaatatattatttgggaggattgctgagagtagaacactatcaaggaagaaaaggaagttaaaagaaatagttcaagaaatgagaaaaacaagcaagtgtctagtggattccttagtaatacaatctgtcaatctccaattatataaatttgacatgtggtttaatggtctaatgtcgatactagttcttgttaagtaattaccttgtctttaagtgctgaattgaaaaccaagaatgctatggccaaacaaaattacataggaaacatcaatgtcagatgatgtatgcaagatagctttcaaattagccggtggaaaattcaacaattaatactttaaaaaattattacttcagaatcaaataattagtatttatgatagggaaactcactgcaagagactcttgtacagttgtactgaggttttgaaaggaaaaatgtacgtgatcttgttttcacatgctaatggttcaaatattgttacatgatttttaattcgagtaaaaaagaatgctgcggattaagagtggaattagcataaacttgagtgatgcattatcttcaggttcttcacctttgatggaaggtctctctactgaagcctcactcttcaaatcctcaagcaattgcaactcctcaaaaattgttttctgtggtttgtcttgaccgtgtacttagagggaattacacggaattttccttcatttaactactcttgtttatttagtgattcttgtgggataggattaggaagcttcaagggatttcctaaaagtgccttctttgtgatggcctaccttggtcctatagggggtatttcgcctcaaacagaattgcattattttcttgattgtgccttgaaacaaccgtgaatcagttctttcttggatgactatggtttgagcaatttcaagccatcatgtcaaatgataacaatcaacaagtggtaaaaattggcgtgaattgtataagttttatactcttgttaatcttgaattgacgtacgtaaatctaacacaaatattggatatgataccctaacaattagaaaagtctcacggagatcagcagtgaaagataaattagccttcacttcccaattcgaattctgccaatgcaacaatttatggtcaattttaccagcgcacgcgcagtcacaaatgttgactttcctaactccacctctaaggcgagtgtcctgattagcttaactaaactaaaaaatgaacattagtcgtttttgcactgctctcattttcgttgtcaatgttgtcataggagatttccaggtgaaagcacacatagtgcgagatgccaaattgttgtacatgcctcccaaatttgattcaatccaggtggtataaagatttcgttctaatctatataaatatttcaatcctcacatatatgttttaatttcgttcgtagtctttcttgttgaatgcgtaaaatcttcaacaatgattggatcgaacttgaaattattgatacattattattcaaggttagacgcagtgcagcacggcttaaataacatatctcaaagagagtagcgtaattggattgctttataagaaatgtgggggaggggggagggttattgatagagataaaaacattaaaggaagtaaattacagaaatgacaaaaatacaggggtatatttttttttttaaacatgaagacacacaatacatcatctctcatctagacatcatctccaccgctttgtccacattattgttcacgccctccttttcataaaagtagtaagatgcagcaaaatcacagtattatagatgtttgcctcttacataccagatcatgtgactttgatagaaaggattctgttacttttttctagacacagctgctgcaatcccacctgctataagtcctacagcagttgcagcaatgcctaggccaatgacaccatctacaatgaaagaaaagaagcagtcagtgcttatcctcttgctcttggcaagaaaaaaggagcagagaaaaatgttagtggaaaatcaagaattgatgggaacctttggtgatcttatcctcgattgtcgtcttgagtgtcactgcctgcctccagtcgggtgcaatctaaggaagaaaacattgacatgatatcacattaaagtacatagatgctgcattggtgcatatgcaatagatcaaaatttaaaataaaaaatgctgtgctttgcccttgcttggaatttgttgttgggtttggagagggatatcacaaaaaaaccccaaaacttatagatactgaatctataactttttcctctataacaaagaaacaacgcatcaaagacttgagtatatgaaaaggaaaagaggagtaaaaaagacttgagtatatgattctagtgaaccaatgtctacattcaacaaccagtgtctaagtgttcaagatggttaactcaatttcaaatcgtgtggagacatcaggtaagagatgtcccaacagacgatgtattgtattcctttctgtcaacgcattgttacagtaaaataagtacaggcttcagagaatgcatacagaagtcagattctattccaaaacatgtttttgaatgcaagatacagatgacaactagctacacattgaaactatattagcaaatatagttcgggcattatgctagagagtagagacaccacacaaacacaacctccttctccttcaggtccaaaacatacacctctgccacactgattaggggaaatcaatagcagaaaacacaaggttgtgatactttttttccacaaaaagaaaaggcaaaatcattatgctgtataattaggatttgtctcctctaaagtaagtcccgagtaaaggataaagtaagcaatcttagtcatcgatgagaaactcattggtcgatactgcatggacatgttacatgtataagaaaatctaaatgtgactaaatatcacgattgagattccttagagagatggatacataccgcgaggcacctgtcgacgagatccctactccttgaataatcagaatttctatagtatccaacagccagaagataaagcttctccctttgctgcaatgggtcctttgtggcaggcaaagatgctgccatttacatgtaattacatgtcatttaactatcaattaacatacatacatacataattgaattgcatgatgaaagagtaaaagagagagagaccttcaagcatggctatcccacggtgcacatcttgtgggtgtttggagtgaacaagagcccatgataaacgcaagagacagtcttgcatatactcttcagatgattgtttttctgcctccaacacctctctttcacatccctgccagtgcagtgccacacacaagaacaattaattaatcaattgcaatctcaaacacttaaaaacatacataattgataagaaatagattgaatagagaaattttgagattgacaaccctagcagagaaagagcatatgaatatgaaacatacagcgacgacgtcagagtcacaataaggaaggtggtctttgccggagaagaactgacccaccgagtccacgatcatccctagcttcgcttcaagtttcgccatttctacacacaccgagttcaaccgagtttccagtgagttgactttgcttcaccaactcgctccctctcttcagattaattgccgcggacaccgcctcctaagtactaaacccccataaatataacattttcttttctgcaattattatttattagtcgctgatggtgtaataaatactttttttttcttactgtatttcttgtgatctggtcataaacttgtgtaatgcaaaattatgtcgcgttttgaaaacttcagaattaagtcatttcgtaatatcttgtgacaggcaaacgaagataggtctggtgggggcagaaaacaatcctcttgctaaaaattgacacttcttcgaagttcgttgcattttatattttaattgtttctatgatatttgcaaccgatataaaacttacatacattttttagttcttataatttagtaatttttattatttgttattttaaagttattttttttattagatgtcaaaattaggtcttttcattgttaccagttatcccttagcttacttatttgacagacaaaatctaactaatcaaatatgtggaaaatattttgcatatcataatatcttaaaaaatgtccatattagaatttacatgttttaatatatgaaatttcgtattatttaaaataaaaatattttgatatctgaaatgcttttcgtgttattgattagttataaaccatcctatcaattaagtagatgatgactaatgtcaacaaatgttaaattttgaatgtcaaaccaacaaagagacccaatttcaaaattcagtgtatgggaattaaaattgcatcaaaataagagcactagaatttaggatcccatcctagtttcttacatgcatttcttccctttatatttgtgttttctcaaaacattgttattaacacaaattgagacaaggacgaaagagacagctagggaaattgcgaggtgccttgctaacattaagagtacacttctgaggtgaggttcacttcttggcttcatcaaagtagttgatacttacaaggccccacccccacaatggttagttcataatatatgtttacttgagcataacgcataatcatacaaataatgttgagagcttcacaaacagagtgtattaatgtaagaatgagaacatatttcttattcatagcaaactagcaattttgagagaagtctcttagcttcctgtacatatctaattacttacaaactacaaatgaatcctctatgccaagccaaattgacaaagaaaacaaataaataaaattgaaaaaacaaagcaaaatcaccatgcatatggattttcacaaactaataatctctatcccccactcacttcttttctggttcatgtaaagagagcctcagaaatacaactaatctcaatctcataactatttggagcatattagctacttttgacaagtgaacacgctgtacattatgtaccctgcaaagcattggttccagaaccgtcttgcaaagtcaaaactaaaatctctgaggacaaattcctaagatgctcaagataaaagaatggcttcacaaatctcccatcattctatggtttcattggtacctacagctgcatgatgtagtataatctgaagggcatctcattcagattctccagggaagggttctccttcccactacaattaaatgaattaagatctttaaccatctaatacaactcttgccttcttgagcacatattactctcgggagaaccattttcatcatcttgcttaagtaatgagtccccatttccggtaaaaagtcgggcagatagcatagccgatgaagaagcactgcctgcaattgtttcaacacatgcaaatatgaaagaatatcaattatggttccatacattcatctggatagtcagtggcggcagaattaagtgctatgatcaaatttatcacacctctaaaagaagagcttctctcaaagtccttagttgcatgcaacattattgttccagagagtacaacaatgaagccacatatttctgacacaatagttccaccactttggccatcccaatcctgcaagcattatttttaaatgtaaataggttcttgtaccattcgtagacaacagaaacatcttatgcatttagcattaaatgccaaaactagttgatcataccttaaacattattacactggctagtattgtaagtgttgtgaacatgacatagtatataggagatacaattgctgtgttgaaggtgtcaagagcctgaaatattacaatcatgtcagtgaagaataagtgatccaaaatttcatatataagaactttgtatacaatgcacagagaaaatctcaattctctagaattgatttctttttccattgaatataactcagacatcattttgaacaagacttgataaagaataataaacttcacaaaatataatggatcactatgtcattttgaggagttctcaataccactagtttggcaatatgaatgccagtattttcaacaattaaacaattctttcattttaaacatctaaaagatcaagtcattacatcaagggatagcacattcaaacagattaagaaaccaacaagagtaaagaaacagaaaagtaaccacctagccaggctaatgttcacgtgcacatgcttactaatatgcagatctcttttgtataagaatgatagagtacccaacactaaacctcagaactcagaagagattacataatactacaaaagtaaaatcatgttgtatagagaacttacaatcaattgatatcggaagacaatttctgataagattaaagattatcagtaagcaatgatatagtaccaaacaccaaacctttactagttgcatgatgtaaaacaatttacttttgttgcatcttgatttgacttttgttgtattatgtaatctcttagttctgaggtttagtgtcgggtactctatcttgagttctgggttctgagttctgaggtttgttctatcttgaatttacattccataggaattcgcatgttgtaatactgtatgttgtatggaggatttaatatgcaactagtaaaatcatcggagccattactgataatcttatcagaacagtccacccatggaatgtaattcccctcctactgtctgataagattaacttaaacaaaagaaatattaaaaagaggtatgaaaagaattctagatcatttaaaaagcttagcagaatttcatttcgtaagatttttcattctgttttatattaagttgtcatcttccttaattgtatatgaagttgtagctaaacttccctgcattccaattcaaaggaatagtctggcaacaagaccgcctctatttcctcaaaacaccaaacactacaaaatgataaacaaaaaaactcatatataagtcacaaccaaacagaagcctcaaatctgagcttctttgctttggttgattcctaatttagcaatattataatatatgccaaaggtcaaagtaaataaacttattttcctgacttttccaaaatctcaaaacttgagtctaagcccaaaaatactcctatggaattgatgcctacaacagcagccaagccttatcccattaggtattgggataattaatcaatccacgccattaagctctattcaaaactaattttactgtacaattttttagaagaataaactaatgttgttaggaaccagaatagggatggtaaaactaatgttgatactcaattagaactatatcagaggtataaacctctgttacagtgctgcaatccaagaaaatgaaaaagaaagctagggtaatagctggagactagctccttacacgatgaacaatataaaataaacaaatagcagaaattagagaacccctttcctgaggaagaactagcttcttcactcagggtagccaatattgataccaattttatcattgtccctattcggttatcacacccatcatataatccttctcactctcctccctctatccccttgccaccagtaattttctgttattttctctctctccttcaaccacattcactgatccacatgttccactcttccccactactgcctcctgtgaagcttgtttattgtttcgccataatcactcagatccttattcatgggcgaaatttcacttccttgccactaccatacccatatagtttgtaagggagtctccttcatatatagagacattagcagttttgttgcatttttcatttttgagcctcttaggcccaatgatatcctcctcgctagtatttcttcctcctctttacaataaatctttcttttatcaccccccacgcacaaaaaaaaaaaaaaaaaagttcctatggaatatatgatcaagatagaatagatgaaacacataaaatataaaagataaattttgcatcctatatactaacataacaacttaagaatttttcaaatgtttgaactacctaccactagtaggtcattgataaaaatatatgcacgacaagcccagtgtgctaattttaagatcatgtaacaaaccttattaagataattcatttgcatgatgacagatatagccacaactaacataaaaaaccatgtctctgggtagattaactgatttttcccttcaaaagttaatttcaaagaagttccaagggctttaacactcatcacctgcaaaattatagcaattcagtttagatcagccaccatattattgcagtgttactacaaagcaaacatttttcagtaaatatcattggttattatgacataaataattatccatgtaattggggaaagggagaaaactttatagaccatagcagtctcatataaccatacaactaaaatatatataaagaattatatggaagctgaaactttatttatgaaatgaaattcattattagaaaataggattcgacatgaaatcatgtcccttagattgtatatgttttaaacttaataacttcgagtaaacaaaactttgaagtttaaatcaattatcaaacagaagacttagtaggagagataacagttaattaatttacttacagagagggaacccatcaatgaacaaatgccagtaaaaactagcacattcgtatgcccgcatcttggtgcaaaatggaagaccagaatgaaaaccaatactattactgagcccacatatgccagaaaagctgcaagcagggaggatatatttgtaatcaaggaactacaatgaattgcattcaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaacaagacagtgtattctaacctggttgagtagccatattccatatttccagaacagatgtaataggttgttccttaggagcatgaataacaataatgatactaccagcaatgcacattatacagcccaaaatcccaagattgtgtagcttctctttcagaataatgtcagccaaaacagcactagaggataccatgcaaacatcattgaagaagcaaccatgttatgtcgccaatgttagaagctagcaccaccttaattctcaatcaacaatgaaaattaagggaatacctcacaataatacttaatgcaccaagaggggtaactaggactgctggagcaaacgcataagcaacaaagtttgcaacctctcctacaatcactgtacaataaaccatacagaaacagattctgcaagaaatcagataaataaaaaatgaccgataaactaaaatttgcatattttaatcaaccttcaacttcactacaactgatctaccatatgtgagtgtataataaagaaatctagcaaataataaagcatctgaaacatcaaatccaggttccactatacaatgcaaaacgaaattaattcatcctaacttatgagattcaaaaactctattaaaaataaaatccaattaattccatacaagattggataaaatcaaaaccaattatgaagacaaaataaaaccattaaggtacaagaaaatccagattctacccgaaaaaacgaaaaaataacaatactaaaagcatagaaacaaaattaaacagcacttaaagcttacttgtgatcattcccgcccaccatagtggctccaagagataataatatccaccaacacctacaagacgacaaaaaaattacaaagacatgcataccataaaacaagcttccaaatagaaattctaatagaaaaagaaaaaagagaaattccctcaccagccctgacaccagaaactgctgcagctcttctaaggccttgctttttaatgataaaacttgccccgatgaacccacttgacaccaaagctagtatgagacctttcagattctccttggacagacccatctcgaaaaatcgtaactttcttctgattttggatctcttcttctccttctcttcatggatgagacacgagacaaacacggttcctcagatcattatcattgcttgtttcatgattgtggcatggaaagcaggaaaagatatagtgtgcaccaccacaaccttattattctataccacctgtgagggccccacttgttatttttaaccattttttataatagtattagtatgctcagaatttatgcatttattgcggacattaatgaatacaatgagtttgaatcaaacatgaagtcttaatccaatcgttttttttctttgggggaacattcatgtttcaaagtttttaatgcaacctttaattgatttatgtttgccctcacatgttcaattgaattcttttaacaacgttacctaattgggatattgaatatattctgtttatcttattataattgttgtaaaacaaaaataattttaaaataattattattttaattttttaatataatattaattacattttttcattttcatcccttataatattaaaattaaaatatatatatatgatcactaataaatatttgattttatatatattctttattaaaaaagaatcttcgttttttcggttcgtgataaaacaaaaaatttatttttaatccttgacacttttttaatttataataaattattaaatttcagtgtttattttttgataattttttattttttattagtctttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattattcaatgataaatattattaataatagaatccatgattggaaataacatatatgtcattttttaatagttataatctttcctatttaacgaaaaaagttaattagtgtagtaaaaagcacattaatttttcaaataatttttgtatctttaatttgaaatatatttttaatatttttatcttcatttctttaaacattaattaacatttatcttttggttttggttttgcgtatgatttttcattacttacattagaaattagtcaacttctcaaactaaaagtaataaaaaaattcttaataatatttatatatatatatatatataacattttatgaagaatagaagttgttttagttaaaagtaaaattcgatgtggctaatttgaaagagaaaaggataaaatctaagtatattttagatataatatttttcaattaaaatataaattttcacttcaataattaatactattgaaaattggtttaaaataacaagtggggaccttacaacttggtctaatataacaaggttgcggttgtacacacatcatcaaaataaaactgcctaaaataatccactaattttatcctataaaaaattacaagttgtggcatttatttataaataaataaataaaagaacaaagttaaaaaataatacaaatagtaccgcttgttgcatttttttgtgatggtgtcggaaaaactaacgtaaatatgcgtgttgacttgaacgggtgtgcagtgcatgtgcacatgaagctcccgtgtggagtggtgcaggggattgaacagagggtacacgtgttgcattactgagctggccaatagaaaatgttgaagaagcatcttatggggatatcgttccatggtagccaaatgtaacgtggggttaatattttacatcctacggatacgtgtttcgtattatgtggtggctgaggatttcttgatgttggtcttactcacatctgggcatctaacgtggcccatcgcagcccaaaaattaagaaaatatttccaaatgctccataaatgaaaatataaattatttcaattaaggggaaatgaattttaagaattaataaaattaaaaatatatatcattaacatttgatacttgatagataagaaatattaatataagaaggaaaaattaagactctatttaaagtggttacgagtttttagtttgttgtttccaagctttttgtttggataaaatgaggttgaaggggcttttaaatgaatttcaaaatcattttaactcacatttgaaaatagatttctagttttatgttcttaaaagttgtttcttccccttttaatacattctgtcactcttcacttttcattcagttttcttctcttttccttcaactttcgcatgaggtggtaaaataagttgagtcgactaatttcacatggatctggctgaagaaacctactatactttcttagcttgatcgaaacttgttttgacacaaaaaagggaaaaattacaaaccaaatttttaatgagtttggccatcattttaaaatttcaaattaatgacatttttaacccaacttgctacagaccactacccatatcgagttcaagaatcatgatcaacctaacctaaacttactcaataaaatgtaggattaaagctttaaattgtgagcacaaatttattttgatattttttagcttaatcaaaccttgttccaatttaggcttattttgaagggaaaataatattttattttatgaggaaaaatattatatatataaaaagttttactcagtcatataatcacaacttatcatatatggtaagtttgttgaattttaaaataattattttaaaataattcaaaagatgatttacgattgaatgatagtgtaaaattgtttcattatcggtgcataaacattaaactcttattttattttgaaacatcattattaaccaaaacttgaaaataacaatataattagagttgtgaatattaagggtgttcataaaccgattcaatccaaaaaattgagaaccgaataaataaataaaaaatgaaaggataaaaaattggaaaactaaaaaaatttattgaatagaatttgattttagaaaccaattcaaagtaactcatacatatgtatactcatttctatttttatttcttatataaattatcatataacttatatctatttataaaaatatatttcattaaagatatttttactaattatttgagttaagatgcataagtattatattattagttatataattacgtataaataaaatatttgatattttaaattatttttattattgattatatatcttacattttatttagtattttctataaaaaaaaaagttataagtaagattaaaattgaaaattcaaatctctttaaattggattggatggaattaaaagattaaactaaataaaaaggtaagatgcatgcatgaatgtgtcaaaaaaaactacttagagttctcataggaggtgtgatgctctcggtagtggcattgttccatgaagtaatgtttcagtcgtcgaagacagtgttacttgccctcttgaacgtcatagtgcttcttttctctatgcgaaactttacattaccaaccttgttgcatcgcgtgacttcttctctgtctttggtttcatgttagatttttgtcaccgatgttaactcatcaacagaaggtcgaccttgagactaacttagctcgcttcttcatagagtttttcatccttcatccttcagcatgtatcagcttacacttacttatgggctctcataggagcagtgattgtttacgttgagatggactattgttgaaatacaagtatggggtgaagtctctcattgattaaaaatcaaaaagttgaataacatataagtgaaagaaagacaacatgaacattaagattttgtattaaagtgtgtacatgtcattagaatatatataataaaaccttgaagctgatccttggtagtacaaaatccactatggtcatggttagaataagaaattggacgatgatttgtgatctatgattagctcaccttagtcgtggttgatagcgcaatcatctttactttaccacgatcgtggttcacatgtcaatgctctaattgcatcaaaattgtatgttttcgagctctttttcacatgaaaactcttggacacgtgttgcacaaactaaaactaaactaagttttttccaaaaaaaaaaaaaatgtcaaaatgcatggatacaacatgaaaactcgactgacttaatgttacttacctcattgagcacaacaaggcttccaatgccttctttgtcgtcggtttcatgctgctttttgtcaccacaatgttagcttatcaacgataccttggccttgaggccaacttggtgcacttcttgatgtaactcttcatcattaaccacatatcaatcttcacctccctagaagctctcataggaggagtccctttttatcttcttttggagatggaccactgtttcactagtgtccttgcgtcatcaccgaagcttgacaacgacgacgcgtcggagcctggcgtttagttttcgattccatgtaatttcattttgattcagttgattttataaggtttgtcttttcatgttcgtgcacttcctgatggagtagtagttttcgattgtatttagtttccgattcaatgtgattttgttttgaattagttgattttataaggtttgtttgttcattttcgtgtttgtaccagtctggaatagtgttcttgttctttggttgttgtttgtttcactaatcaagtgattttacaatgttggtttcatcttgtttatttgtgttcctatttcttaatgccaccattaccaaacataattgatctgatctcgtcaattgtctctgcttattgtaacttcgtgtttttttcatttcatataggaaagctaattaactaaatggattggtggatgtgttgttttagttcttgttgatttttatcctcctatttttgttttttctattttcaattgtattttttagacgatcaattaaaaaaaggaaaaataatatataagtactttacatgtttaatagatacctttgactctcattttatctcaatcaatacttaaaacttttatcattgttttaataggttcttcccttaacttaatgctaaatatatataattaaaaaagtctatttatatccttgatttcaatgaatatcaatggttggttatttttgtatttaaaatattaaaatcatataaaatagttattaaatattgttaaaaaaaactagttattcaggaaattgaaagaaaaactaaaggacccattgaatgaaatgtttcccttggttgatgatttgcatgaatcaattcttgtgttgatatatccgtattccactatgtccctcattgttgatgttttgccctagaatgaaatgaagctcctggtggaagctttacattttatgtttgtgttttcaagtatatttaatctactgatacaaataaacttaagaacaaaaggtacgtcccactaattactgcatgcaataattaatgtggaacgcctttgattgtcgacttctcgacaattcttacactataacacttcattcaagtgataggttaccaaaaagtaaatacattttgttggtgtagataataccaattaattttcttaagtcatcattaactatacagtgtcatacttatacaacctctatatccctctcattccgatataattcgtctggaatgttacacaatgcattaatggtaaaacaaaagccatgcatgaagcattggaatccttctcttaatttcttgagaattggtcatagcaaaagaataaaacaagatccaagaataaactatattactagttatgattgtcaaaaaaaatatttttatggtcctaagtcaaagaccacatgtgtccctcaacccactggatcaaagactaatctcattcgtagtacgtgattgttgcttatccaagaaaatttagcatacgataaaaataaaacacgattattctactaaatagatcattttcagtcatgtgaacacaatgagaccttacaccactatgcaaatcctttgggtttgtcaaagattgatatataaatttaaaggaaaggaataattcaaaaatcttaaaagatgctggaacaatgtctctgtctgggtacatgcattctatgacttactggaatcgcatcaaactttaatcgaatgaaggaaacttaagcaagaagccgagagatcacttttcattcactatgctgagtataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaacctttccattcactaatgaaactcacttgaaggagctacaagatctcggaaattaaagctataattaccacaaaaatccaatacatttttgtctacatcagctaacataatactttatggggtgagcattaaaatccaataaaattgcagagttgacaatgtacagtttcctaagtatgtctatagcaagtgggtaaaactcttcgcttttcaagattttcgccatgtcactttgcttggtcatcttcgaaggagtagaaatcaaaaaggaaaaagaaacaattggcaagactaatttttcatcttgcattagatcttttcggcttcagccatcttcaaggatgtgaatcccagtgtagggatatttctcatatccgccaaaacacaccaaaaagggatccgcaaggtcttattcgcatgggtggaagaaaaaaattccacagaatgtacaattgctgaagctgtataaatgcagagtgaaagccaacagccaacactcttgtaatcagccactctaatccccaccaagttggttactttatacctgaagagaagccttgtcttgaaggaaacccaccgggttgtgtcctataaggtttctcactagcaaagcgtttgtccgatggcccagcacctaggatcccgagtgagttaggatcagtaatccggactccattacttatggtcctttgaggtggtggctgaccctggaaatgattgtcactttcagttcttcttcttcgtttccatgcctcggatttcccagtattatcaactggttctggcatttgataggtagccatattttttaatcctctttgcctctccatatggcgatggaatggatttccatttctgctaaatgaaacagataatgacccattggcgtgagaggggccaacccctgcctcatcttgctcctgtctaagtttggaatatatttgatgaagcctctcccctgaaagatgggaaaaggtggacacatatttccacagtcgcacagtcattcctgtaaataagcaaaaacaaaaaacaaaaaaaaaaaatcaacacgtggtagagaatcctaaaaaccgttaatcaacaactatcttaacctatcctcttgagaggcaataggagaccaacagcaaaaacaaaaggatatcatacaaaaacaaaacagaaacctttccaagaggaatgaaaacttactatcttgcttatagggttcctgttcatgttctagcacaatttgatctatccttctcccaagaagttgtaaatagttgcgtatttttgaaagcacctaaagtagggaggcagtaaacagtgagacaataaataaaaaaaggacgtactacaaggaaataagccaaaagacataccttttcctttggaagattggcactagtttgctgcaacctgtgaagacgtttcaaagttttcatttcttcaaccatcacatcttgacaccattccatccattttacctccttaaactgctcatatacttcctcattgtcagacatttcaccctcttcctttactatagattcaaccttctggggtttctgaaatctatcctttctcatttggacattaacagaactcgattttttctttttctcctgcccacgtaacagtgagatattaatcatattttctctctctttcttggaaggcttccgtccaactctgctgttggcatttttcacaccaagaactgcaagttcctatacaacaagaaaatcaagacatcatggtaagtgacaaacaatgaagatagattcaacaaagagcgtagcatctatcaacaaataaaggtacacaggaagaattaaaaaagcttagtaggaaagtagatcataaattggtgggtgggggatgttaacatgcacatgaaaagattggggtattgcttcaaatcatctttaatcaatggaatacacaaaacgagtgataaaaaaatgccagcattcacatccctttggtacactaaaatatcaacaaattggtaaaacatacgtcttggaacatgtcacagaagtggatactatgaatgcaagtcaaataaaattcagggctatgcaggacaatcattagcgtggaaactaaagtccactaatttacaaaattgaaacgaaaacaaacaagcgtgcatgtaaatcatatagccaagatgatagaatacacagccagaaatctcctatttacgcaagtattataatattcttgattctgaatctgatatcagtctgagattaaacactcatatacattcactcaacaaaattcccttctcccacaactttttgccaactctattctgactaatagcatgcatattaccctcaattcacattatgaccaccgtactatcatgtgtagcttctccacctcttattctcttctttctagtaaataccctagtgattgagatataatacatgtgaaacattaaataccaaacaatgacatgaagggtaattaacaaagaagaataggaagcatgtaaaagcattagaaacaaagaaagagcaaagaacaagcaaaaaaagaaattaaagaccccttggcagattcataaattgtaaatacagaagaaaaagaaaaaaaaaaaaaaaaaaaacataatgctgaaataagaatttagttaattgcatacttgctccaaaagggcattagcacggtctttcaaatttggagctcgtggcaagaaagtttcatggtgttgaagttctacaggtgcaattttttttgtaaggccaagtctttcatctaatctaatcttttcccaattaccaaacccatggtaatgtattccaagaagcaatctagcatcatcaactgaaaacaggcaaaatacaattagcaaagcagcaataaagtcaacagaataatatcacaaattatataagaggatacacctactttgattccatccacaacctttggaccagtttgatggtttgagatatgacagaacacgaaattgtgcaataggatcttcatatcgaccaatgcgttttgccaaaagttgaagttgttggacacgggtaagtagatcatttgccttcactggtacaccaaaaaaatccagcaaaggcccctggatgcaatattattagatgttataagcttctaaaaaaataagaatacaaataaccatttcaaaccctatctattatagggaacttatcgttataccaacctttgcatctagatttccaagttctattgcttctgtacagccatcaataagagcattgaaaagttcaatctgtgctccaggtggagctgccccaacagcaccaccaacctcggcaacaattaagtcaacttggctctcattgccatatttcataacctggcaaattaattggggatgaacataaaataggaaaaattatttactgctaaagaaaataacaaaatgaagcattttacaagacatacatgcacaaacagcaaacacaaaatgataacgcacaataaaagaaaagcccaaagaacaataaaaagaaaaggttattcattaactcaagggaggtgtaaatgcaacgtcaacacacccacttgctatgacccacagggcagtaccacaattaactctatcctaaaaaggagcaaggaagagatcttagatgctgacaaggaatagatcactccctacttaaacagaaattaaagaacaagtacaacgtcaacacccacttgctatgacccacagggcagtaccacaattaactctatcctaaaaaaggagcaaggaagaaatcttagatgctgacaaggagtagatcactccctacttaaacagaaattaaagaacaagtacatgtcaccataaaaagcatgtcatttctgtaacaaaaacagcaaaattcaagaaagcaaacactttccagtcaccatgaactccattttgtgctggctttaattcatagtcaagcttagcctaagactatcatgcatgcacaaaagtccatatgatttaattcttgaagaaaagaatcaacatcaacatcaacatcaacagcacctttaacccaagttaattggggtcggtggtagatgaacccaatgatagaataccaaatattaattgcttccaagtaatgtatatggaaacataaattatagttttatattcaatatattagtaaagaaacaaactctagaatcggatcggttagaaattcagtgccacctcaagctcatagcaccattaatccatgcataagccaaaaatttagcctatccaaccggctaagtaaaatatgaagaaataactattcagttctattctgctcaactacaattttatggtcctatctcagatttctaatctttacaatacaaacttctacgttctaaagtttaaatgcagatcctacagcacctagttagctaactttttcagaatggaagagagaaaatagcatcagaatagtgggatgaagatcatcaacaatatattaatttaggaaatgcttctgtctccaatataggaagataacaaaagcaatagattttgtttatagtgagacaacactgaaaattgtgagaagtattagaatcttactgaacgagaaaaacgaagtgcgtctcttttagataaattcccatatgaccaatttctcacttggacagatgctccctcaatcattggtactgcaggagcggaatactctgctttccggcgtttcgaaactcgttcagttggttcaggttccttcttttttcttttattacttctttcagatggatcaacctctgcataacttttaatatttctagcagatcgaggaacaagagcttcctacaagaaccaataaagatgaggcacataaaagaaaatcaatttaagcattaactgaaacaaacattacacaaaattattagaaactcaacaacatttgagaattttttaataatatatctataaaagaacaggatcaaacctctgcttcgaatacagcatcaggctttatccaacggctccagaaacttccatcatcctcatcattgcaaaaattggcaacctgtaaaaagtaaatagaaacaacttagcaattcctcaccatatacaaatctatctcttcccaaaccagagaaataaagatgatatcaacaaaaaaatcaattttaaaacagaaacaacaaaattcacagcactgtccaaatatcttgccttaaaagcacccaataattcatttccttgttccccgtcagcttccttctcttcaactttctctgctctttcaagaatctcatctatatccatacttaagagtcgtttcttgctttcttcatcatttctttcttccttaaaaagctcctctgctccaaatcgtaagattgcagacagctcattctgtcatttcagaaacaaatgattggtgcagtaatcgtgtaattaaatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaagtctgcataaactaaaacaattcaatgcagtccataaatgatgaaagcaaggtaataaatattcacatgaaattacagttttcacaaatgtccttactttgtcaaaacaacttcccccttttttggcttctttcttttccagtctaccctctgcatttagtttttgaatcaccaagtggtccagaacctatggaacacattcacatgaaaaatgacataaaattgttgacctcaaggattggcaataagcaattgaatgtcttttaggaaaaaatatacattaaacataaaaatataggatgccaaagttggagaaaaagagatgaaacaaaaacagccagcggatatctaatgatttttaacataccattttcttcttagcacgttccagaatatcttcctcaacacttttgcttgtaacaaatctatatatgttaacaacttcttgttgtccaattctatgagctctactcattgcctaaaaaacataaaagtaacagtaagcaccaactatttcattgattaataataaaattacatcagctaaatacctgcaggtcattttgaggattccaatcagaatcaaatattataacagtgtctgctgtggcaaggttgatacccagacctcctgcccgtgttgacagaaggaagcaaaaatcatcactaccaggtgcattgaaatgatccatagcttgttgtcgaagctcagcttttgtactgccatcaagcctctgaaattgaaaccctcgaagtgacatatactcacccagtatatctaacatcctaaccatctgcaatacaactctgttaagttagaatcatcatacactaatccttaaagcacatttcttttgtttcaaaaattaaagcagactaggatgcttagacaagcaacatcaaaagttagaagttatttatgattttcacatccacctgttcatgaattatgcacaagaagtaagtcctaaatcaatagtgaaagatttaagacttcagagagaccagcaatcatatttgttcaccagcaatcagtaatagatcgatcagtatttttgtcagcggtaggtttatcctaatcaattaaatgaatttatggtttcagttcatagattattcaaaggatttgaggtcttgaagaacaatgttgatcaaactatttccctatttttttagatctgtaatagatcaatcagtattttcgtcagcagtaggtttatcctaatcaattaaatgaatttttggtttcagttcataaatgttgagcattaggacttgaagagcaatgttcacataaaaagctaaacagtcaggtaagagataagaaaattcctcgaccatcaccctttaacacatgcacatacacaatgttcagcatattggggttggggggacttaaaacaattagacaccaaaattgattcactacaacacttgtactgtaacatattttaaggaatggttcacacgtcaataactggagagttattgtcattgacagctgataaaaaaaattcaatctaatttccttccctagttctattcggtcaattagaagcgtaagaacaacttattctttcaattacccctggtaaagtagataacaataccagctaaatgagcatgcttaataacaccgagacaaaaagcagaaatatatagtttaatatgatatatgtcattgaaatacatcccacaccactaagtttaagtgaataatggcacataaaaatgtgatcacacaaacattccagtagatcatctttaaaacaactaaaagaaaattttatatttattgcaactgaacaaaaagtacacttcatagttgagctaaactaaagaaaaagtatgatgaaacatcgtggagctaaaagcttccaattatatcaagaagcacatccagtaaaccagttttaattttcaacaacaaacctgagagaaaatcaaaacacgatgcttggtttcatgcaatctaacaagcagcttatcaagtatgacaagcttgccactgctaaaaacaattctctctagtttactgttgtcactacttcttgagtccccaccatagccatggtcagcactttcaaacaagaagggatggttgcagcacttctttaattccaccacaatatttaaaagagaaacctgaaatttagcagaaaaagatttgtgatgatctttcaagagaaaagaatatagaaatatacattatgaattaaaacttctccgaattgtcagtccagatgataataaacagatgcaacatttcattttaatatcttctcccttttttttaattcattttgggtattttttattttcataatatcttctccctttaattgaatattaccaacaaaagaaattaaaaaaatgtacctcagctccttgacatgcacataaatttaccttatactgtaatttttttccacttaaataaaaaagggaaaaaaacataaaggctccttaaacttttctccttttacaaacagacaccctaaactttatgtctcaattcagtcaattaatccttaaactttatctcttctgcaaataggcaccatgaactatatttttgtttcaatcaatccttaaagtttacgtcttttgcacataaatacctaaatttcaatttcatctcaattaattcttaaaaaattatccctttcattaataatcttgtgttaaaataaatttaaattaaattaccaacaaaaaagaaatttctaaacttttccaaacattaaaacataataaaatttaggatcaaaaaataaaatggaaattttaaaattaattttattattacccttttatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttaagataaataacttgaaaaaaaatatttgtaaaacggataaattttaaagatcaattgaaatgcaattaaagttcaaggtgtctatttacaaaaagattaaagtttacatatcaatcataataaatttaaagtttctggtgtctattcgcaaaattgagacaaaattaaattttagggtgtctatttgcaaaagaagtaaagtgtaacggagtttaatgttattttcccaataaaaataagaaatcttaaaaataataaactgcactaactctagcttgctactgttgacaatcaatgaagtttgcatggtggaaagaaaccacccatcaaagccaagtattggcatttcctatttaattaaccatcatcatgaagaaagcacatgattcatgtacgttatgaacaaacgattgttagaaacacaggaaagggatgtaacctgattcccacgaactcctttgttcaaattgtgaaaattacgttccaaaatccacttataatacctacacgaaggaatacatcaacaggaatttagaaagtgaacttacaataatagtatttttccaaaagaaaaaactttcagaactaaaattgcacttactgtttctgaagaggcgacatttcaaccctaaggatacgctcaattttggggggtaatgatttctccacatctttgataactcttcgaagtatgtgaggtctcaattccatatgcagatttgcaagctaacaaaataatttatgcacatcaaattacagtgaggcagaagtcgagaaactcgagatcaaggaaaatcaagaagcagagaaaaaaagtaaagggtatccatgacaacttatacctcattctcattaaaagaactcagattcttatagttttgaacaaattcatccttgctcctgaacttgtccggatcaaggaaatgaagcaaagccctacaaaacagggagggagaggggaggggaattgtcaaacaaacaagaaaaccaaagcaaacaaaataacagacaacacacataatagaaatcaatttagtggacatataataagaaacaatcaatcaagggagtctcccaaaaactactaaactctgtatttgtgagcttgcataaatatacatgctatttatacaataatgaaaagtaggggtgcaagcggaacggacccaatccgcgaacccgcctagtctgacccaaccagtttagaattttgtggttggattgggtcattgaattggattggttttatttttatgaacccaattgtaattggattgggtgacaggtttaaaattttggacccaataaaaacccaacccaaccagcatatactaaaacaaacataacaaaatactaattatatattataaattaaacttaatagtaaattactaatatagaaattagaaaactctaaagctaagtcactcagtcttgcaagccgcaatagcgtttctccctaaaaccctcgccgtcatcaccatagttgtaaaaccataattgaacatggcatggagcaaatgaacaaaggaatggagttggttgacttatcttttgtaaaacaatgttatatttaaggtttatctttttctatttatcaggagttgtacaatgttttatgaacacagttttttaaaattatcccttactttttttttagtttaaggattttcttatttttttttaagacaaagatgtggttattttttaatgacccaacctgataaccaatccaatccaattaaagttggataggattgggttgtaaaaaagaaggtaatcccaacccaatccaattaagcttaattggattgagttgaaaaacacacaaaattcaacctaatctgtgggccacttacacccctaatgaaaaggcaaaaaactagaagcccccttgcggggtaagactggaggatgccatgatgtaagctgctttaaatggttaatgtaaatgtaaatgtaaatgatatacaaataactcatcatttactaggtcacacatcaagcagttaataatatcattatattcagtaatagcatttattaacatttatccatacaacaatattaagaaatccaacaaatccacaaaagatgtaagtttacttttttgacaattcaaatacgaaaggaaaatgttaatgataccatagttcttccacactgttctgtagaggagtaccagtgataagcaacttgttcttggtgctaaattcctaaaagattagcacaaaacaagccataaaatattaaattctatcataaacaattgcacagaaataaattaagagaaatgttacatactgaaagtgtcgtgtacaactgtgcctcactattttttagcctatgagcctcatccaccatcagataattccatttgatcttagagagaacagccttatccttcaaaactacttcatatgtagtcaacagtgcattgaattttattggcttcccagtttttttctcattataaaattcatattgttgacaaacctgccacaaaatgaaaaacaaaaaatcatatgtaaaagaaataaataaaataaaaagcttgcagaatttaggcttaattatattttttggtccctcaaaatcaaagttggggtctgtcttttttagtccctcaaatttgcaaaatgctttttctagtcccctcctgactgatttttgacagtttatcgcaagagggactaaaaaacatttcgcatatttgggggactaaaaaagatagacccaaaaatttgatggactaaaaacatatttaagtctaggctttttaaaaacataacttaaattcaaagaaaaatatcaaaaccacatccacttactccactgagtatagcttaaatttcttttcatgtagcaagaaataaccaagcaaatcaaagagaagtatacatccatagcaatatagggaaaaggtgattaaatgctagaaagacaaaatttgaagcatggaagacttgacaaaattcataaatcataacttaaagacaaactcagaaatgtctcacctctcgacttgcacgagtaccaacatatatgataatattcatatcaggaagccacttcctgaattctttggcccaatttgataaagtggacaatggaacaactacaagaaaaggaccatggatttgctgggcattctgtgcaaggaacaaaaacgcacgtattattacattgcaagggcaagtgtaatcaaatagagaattgatactacacctgcagaaaaccaagcatcgatactgactgaacagttttcccgaggcccatttcatcggctaaaatgacatttgtatcgtttctccaactgcaaaatgcaatacacagatttagaacaccaaaaaattaaaacgtaccttgacaaatatacaagcatgcatacctgttaacgagaaaattcagaccctcaagttgataatcacggagctttccacccttcaaccattcaggttgttcctcaagcttccgcaaacttgctaaacatcaaaaccaaagattaaaatcagaacttacatagataatatcatgatattctgtacatgaaataatgaaccaaaatattctttatatggtattaaaattaaccaaagaaccaataaaaggaaataggcttcagaaggcaggaactacaaataaaaggaaactatcaaataattctcaatcacccctctccaaatcaactttctcaaatttaagcttaagtaatgattaaatgcaattttagattgaacagatcaaagttaattgttaataatctgatatattaaaaaataagacacgtcatctttgcccagaaacagaaaaaatgaaaaataaaagttacatcctctaaaaaaatctaatacaatgttaaattacatattaagaacatgtagaataaaatggtgacacataaatgaccaaaaaaatttacacctatatctataaggttttctcaactacaaagtttatctttaacgtaatcaattaaaaattgtagttttgcatattaaaaattattttaataatctactaagtagaaaaggagtaatacagtatacaatttcctcaataaagcaattttaaaagtgtcctaaaagatttcacaatataaaactagtaaaaagtcacacctagagtccaatggctttccaaagaaataccaaattcataccaaaaataaaagttcaatcatgtcccagcctgctcctatatttaatagagcagacatgccatgaaaaaaatgaccctaatttgatatataatcaagtaaatcaagactgagaagtccctcgtgatatgaacataaccgaagtggatttctggtacactaaacaaattatagtgatacaacataattggtaaaggtgtacgaaatactgttggtctttttgtttagtaatttaattccaagaacttagaaactatattgttgtagataaaaatgataataacacaagtttaccacaccagcgaccatgtcaagtgcatacacagaatctgtcgaaatgttccgaattttattgaaaaaagagcactgcccacaaacaagtcgaggagtctaccaacctttgctcttcttacgctgagaatctaccatctttccttgaactgccatagcagcctcacgagcctgttcaaatatggcagaacaaaaagttcattgtaagataaataggtaatatccaaattatcatatataaatcttattaacatgtatgcattgcaataaatacaacaaccaggcctagtctattcctagtgggttcagatgtgaaactcccaaaactaccctaggagataaccattcttagcactgctctcaaccaagcatgcacagcaccagaagtttaattcaattgaaggcagaaatacaggagatggataataacttccataagaagaatgactacaaccacataaggaacttttcaaaaccaatacaataatgagaatagagtgaaatagagacttaccttatactcatcaatagcatgttgagcaaaagcaatatcaatgtccttttccctagtacatcaagagtgacaaattacatagaatcaataaaacagaatagatgccttataacagagaaaactaacatcatagtatcatacttgctaaataaagatctaaaagtttaaaacttggagtacaacaatgcttagagatcaatccatcctcctctctaacatgaagacactcgattcacagaaaatgaaacaaaaaatataagtaaatcataactaaatttttagcgtagtgtaccaagtcgcttcagcataagatagtccttgccacttgaccaagtattctggaataacattgccagaattatctttgctgatcctatctgcaattattctttccacctgaaaatgcaaataaacaatccaattagcaaatagcaatacatcagagaaaacaagaccaaagtaatgaaaatattggaatgcaggaaagcaaacctgactgttctgtttgataatatctagatccatctccttactaacgtcattaacctcaatctgcatacaggaacacccaaacaagaaatttttaaaaaaacataaataatatcaatgttcttttccggataaactatttccaccaaataaatttccacaaaaacttctgcagtatttatagcctccagacctattaaataaactggagcatctaaattgattggctgaactcaaataattacctcctctcttgagattgtcctcctgtacctgatgtcttccattattttctttgtataattcaaaaccttcttaaaaccactgagctgcaatctcacataaagacagaatgtattaaattttggccaaaaaaaaaaaaactcaacatgtgaaagagtaaaacaaccaaacaataagaagcaggattgttataataaaaaacagagactgaccgaaagacagtaacaacagaataacaatgattaatgcataataaacaataagaataaatatcatacgttttgcagctcagcaaaagatttccactgacagtgcaaatgtgactgccctttccattttatcaaaaattcgatctcattccaatcaatttccgaatcaaacaagtgactcattaaaacaggctctgttgatctattattcctttgagcatcttcagccatgccctttggctgatgccagagcaccttttcaatggagtcaccatcgtcctcttccatttcttcctgaagagcacttaaaagaatcacatcagtagaaataaatttaaagtatatattaagtaaataggaggtatcataatagcataactaacatctcatactcccaccagaaagccattccaatataaaaagcttaatagcctaataaaatcatcattgctagattaaagtacactgatccttttgatagatataataaactagaattaaagaaggcgtctacaaaaaaatgacatatatccactccgtactctaacaaatctattatccttccagagagatagattgggaaatctcaaacatcaaaaccaatgcagctgaaattaccatcttgcatctttagcatcaactccgtcaagcaatcagcaaacctcataactgagatctctccaccaccaccacaccaaaagtaaagaatagaacagctggcacaaattgcaaacataagctaatggtctccaccaagtggccatataccactcaaaacaaaatatccaatttcataagctttcttcaagccagtaatcattctcttttctctcactcaaagacaatatacaaaggataaaaaacatcacctcctttcctatatccttaaaaattctcaattttctgaatgacgatttaaaacaagacttgagtgtatttgttccaattctcctcagtaaaacacccaataaatttaataatcctatctcttacgcacgatagttcatactataaataatgaaaattaaaagaaacaccaaaataatagataactcaacaatcatcagttcatttcaacataattccattttttatttttttcccatcacattgaactgaaacagaggaatagaaaatacattattttcagattttaagtgcattcaaacataccttccacttcctacgaaacattaatctgaactttaattttgctggtaaaaaaaaaatctgaactttaaatcatgcaatctcacatccactcacccccaaaaacagataaaacacacatcttagaagggctgcgcaggtggacataagatactagttacagatataaaaaatattgggacaacttttttgtggtcattcatgtatcctaatttggagccaaccttcacctagtaagataaggctttgttgttgttgatgtatccttatttggaacagttttagcaggttaggtttaaaatggtgatggtgaaaagtaggtgaaaatttctgggcactacacagtttatgcagcccattcatgtacttggttggagctgtacacttgcaactttaggggtgtctctctactctgcagcttaatttcatttaggattgtgcttttggctccactataagctgctcggatccaatgattatttcaatggagtagtgacttccctctcttctttgtaataaataaatctttttttgtcatcaaatatatgtaaaacttatccttgttaaataaaaccacaacttcctaataatatactaccaattttttttaatcaataagaagaaaaaaatgtctaaccagtagtcatttgcgatgcaagtgaaaacatcctttggagggtatgttatcccaagtgacatgatgatttgagtcttatatgtgagaatcaatatttaacatttaattttagtagataaataaaccccaaaagataggaggtagaaaccatgctcagatgtgtataatgaaggttgtaccttttgggactttttctttttcccttcatcagcttcttcactctcttcactttcaacatatgataccttcctaactgtcctactagaagtgcgaacctcactgttgcgcaaagaaaaacctgtggctgaagatgatcgaccattgttcttgcggacatgaacactccgcttttttgtgcttttgaaatcctcatcactatcactgtcggaatcctccgttgttgactcgttggcctcaaaagatgatttaacccttctttgtcgacctgatgcagcatacactttgcgatctctggtagattttatgttttgtccaatcttacctcgttgccttcctttaggtcttttagcatagaaagattcatcatcatctgagacaactatattttcgtcactgtcatcatcttcatccgagccttcaccttcccaatctttatcctgcaaaataacaacagttaaaccatttgatattattaggaaacatccaccaaaaaaccaagacatattaacttcaaaagtcaaaactagcagtaaagcaaaatttgtcctctaatgaacatatacaagcccttactagataaaagaccattaatgaaatagaattcagcaacaacaataaccacaaataaatgaccttgtttccagcatgaacacttgtggcgggctcaaagtctgcatcgtcaggatcatcttctgcatgatgttaacattaaaaaatcacagttgttcttcactaatcagaactatgtaataaaggccaaacattagctattttaaaagcagtactccatacttaagaaacaatctttatataaataaaatgctcgacataccatctgcttcgtcctcttcttcataatcagcatcatcaccatcatcatcatcttcaccatcattatcttcaacatcatctgaaaaccttgaattcctatgcaaagttctatttgcagaggtcgacatccgttgtggccatgaattcgatccagtgggctttttgatcccaccgtaatgcaatgagtcactttgctcttccccatcctgctcataatactcatcagacaacatctcttcagcaggaacatcagagtgacctcttggaccttttcctgcctccttttgtccatcatcatcatcatctgagtctactcttcccactcttccatccaatgaattatcttcagacccatctgcatttctataatctgatccactttttgattcctgcccagattcagaaccattttgagggtccatttgcccacagtccttccaaaatgttgaaccccaccttccgaccatagctgttttgctaccagtagtctgcaagtttgattctttcacagcatccccatcgtcggctgttgcctcagtttgcagtctagtggaaccatctggttcaccatcactctcatactgtgcctccatgttcatatcaaattctttctcactagaagttgcatcagtacaatcattacctactgatctatgaactctattagcattctgtccttggcttttatcttccatgacaccatgtgagactgtatcatttgaaaagttcctaaagaaagccatcctgtaacatatgactaacttactattatctttacttcaatctccacactggatgcaactaatcattaaaaaaaaaagtgacaaaaatccagtgctgcttcagttatcttctgtctccccagtccccaagacctgaaaaacaaagagtgatatacgatcaatagaatcctgaatgatgcccagctcatgccattgatcacacattgatgatataaataacaacatagaatcccgtattacaaccatccagcaagttagaaaagacgtagaggaaaagcatcaaaccaatttacatcttctgcaacacttctacaaatacatacttacaaaaccaccaaacatgcttagctcttagtagacaaattagcaggttcaagtgttcaatcatcagtgactccatagagttgcaattcctttacaaaccacaggttaacaagtgagttaaaattcccatgctatttatttccacacattctctagcagatgtgcaagttgaaatgaaataacaaaaccatgctccaggttcaattcaagcggaacttgtaccaggtatggcaaattcggtttcaacttcaaattctaggttaaaaacagtcctatatgcattatcctaagttcacgaatgaaccacattgatcaaggagtgtaagcactgcttcaaacgactgtcaagtttaacggtcaaaactgaattccgttaacactcgtatttcgccaaaatcgaatttcaacaccgtgcaatgcacaaaaccatcagcatcatatcaaaaacaagttaatctccgaaaagcaacggcaaaaccgaatcgaaagggataaagcaacggatcgagcagcaaactgaacgaagctcgtcactaaaacccttaaggcttggagagcgcgaccttcggaacaaaaaaccgacctaaatccgaaatcggaaccctaattccgaaaccgaatcactaagcaatgagcgaatccatgcgccgatgatgcaagcaagagcgagcgaacgactctcacctttccacgtgcagatagcagaacagagttccggcaatttagttcgaacggaaggaaccgcgacgagtgacggtgcgcaggttaataattgtgagcgctcttcctccgataaggactcgccggaaacggaatcgccggctacgaatatcaaaagtatagaaaagagagagtaaaagggacagaggaatcggttgatgtttcaggaatcgcggtggagcgagattcgaatgaaggagcagcggtggcggagagattcgccgagcgtggcggtggcggtggcagcgggtggtaacttccgatttagagagttaaacgacgacgcgatttggattaaacgacgatgattttcagatgaaagggggaagagagtctttttgtttgccctttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcaggtgtatttttaaataaatttttgaaataaaatttaaaaatgtttataatggtttaaaatgaattttaaaaaaaaaattgtgtatcccttctaaaatccggttagtatggataaattggatacttaggtatgttatgatttattttgattattttgaatgttatatttttgaaaattggatgttttaattgaagtagtatagttcatcatttgttggattaacaaaaaaaaaaaacagcacacataatttattaatcgtctcctaaattgacatggtaagtgcgtacggttatggaatcactatacatcctcattcgatcaatataaggagttggccattgtttcgctttattggaacagtgtgttaaccaaccgaatgcggttaatgggataaaacattgatcttgtagttgtacctttttaaataacattgttactaaaaatttaataaaccaaatatgaaataattaaatgcttcaattaaaacattcaattttcaaaaatataacattcaaaataatcaaaataaatcataacatacctaaatatccaatttatccatactaaatcttccccgaattttagaagggatacacaatcttttttaaaattcattttaaaccattataaacctttttaaattttatttcaaaaatatatttaaaaatacacctgtcatatgaaccatacggatcggcaaatctatatgaatcatatggattaccttatccgtatggactatatggatcaccttatccgtatgaaccatatggatcaacgaattatatggatttgataatctgtatggtttatacggatcaactgatctatatgaaccatatgaatccgctaatccatatgaaccatatgaataagctgatccgtataaatcatacggattacctaatccatatacaactaagtctaaacaccatagagttaaaagctgttgaaagagatatttttgtcattttaaactttatatagtgtatgaagaaatttatatagtgtaagaagtaacactcaaaacattagaatgcaaatcacccttgaaagggtccaaagcagtcagaaacattacaacaaaaattgactagttattataacttatatatgtttttagtttatctcaataagtttaaagaacgttgaaatattttttaaaattattttagtaaattttataattacaattatggataaattaatatatataataaaaacttactcaacaatttttaattagattgttcaatcaattacacattaaatatatttatgttttcatttaatgttaaaataatattaatattatagtatgtgaaatatattaaataaatttttactttaagatagctaggattttattttgtacaataaacaagataaataaatattttaaatttataaattagcttataatttaaattcataataactaaatattttgaacatataaattatattttaaatttataataaataaattatattataaaaaaggttaattttattcttttttataattattttaaaccattgaaatataatttaaaaataaatatgaaaacatatttccatcaaaggtatttttgtttaaaaaagttggaggttaacttagaaaaatgggccggaatagcaaagcatcaggtcattttgggaggtacaggaagcaaaaatggaaatgcaggaagcaattacccaatacaactctttgttggttcaaggccgtcaagtaactagtaaaataatttttttttcttatggactgtttcctttaaaaggtcatggattgaatttaactcttttaaattataaaattcactttaaagagaaaataaaaaaatattaaatttaattattaaaatcataattaaatagacaagcatgtataattagttatataacaagtaacgagtaattaagtttttacttgtttaaatcttaattattatttttttaatatcataatcataattccttattttatttttcaaagtgtcttgttgttcacttaaaaggataatgtcactacgcacctaagttggcttcggaagtggtaaccactaatcagtgtcacaatttacaagttctcgatattttgataataaaatatttgtcgtcaatttcggatgaaaggaatacaaaacagaaatggtcaatgtaatacatttttaggacatattcggattaatttaaaattttaattaggattaaacttaagtttacagattaagtttataaaaatatcccaaatattatttttttaaaactgaattttcagataaaattttgttcttaaatatattttaaaaaataatcaaacatgatttcaaacacatttttctcttaaacatacatttggatgttttcacccaaaatccaaaatccccttgctttttacttgttattcattccaaccaaacgccatgttctctttcgtggagtaataataattccatcacgtaagataacataactacagcatgtgaaaaaaaaaacacactagctaattatcttattggatttttcttaattatattgtgaaatattattatttatcattaaaaaatatcgatgataaaattaatatcatgtattttaatcatgaatttatgataataaatatttattgttggacttttgatatgagtaatttgtgatgaggttttatctcaaattgggatcttagactatttttcagtagacctcatagtgtcacatatgatatttctttcattttatttttaatggtaaatctcattttgtgatcttagagagagaaaaaaaaggaagaaaatttattcttatttgaacaatgtgcaaatcttaagggatcttctataagaactcatcctccatgttagagatcttttcaacttttttattggaagatctaatgaaaatcagattttgaattgaggtgtcaaaatagatcccaccaaacattggctcttaaaaagatcgattgacgaggtagattgagttgtgaaaattatgattctagcttattttgatcctctttgattttagtgtgttgttaattttattttaagatgaatattctctttatatgcatatttttgttttcaatttcgagttatactttattttttaattattatgtattatattttgctattttataatataaatggcaacctatgtttttattatagtttttaagtgattaaaaaatattttgttatattgttatataaaatttaattttttttattttaaaagatgagtgacccatgaacttgcacgtttggcccacagcctgctaaggacatgggtgatttgattcatgtacctcccaaaaattttaaaatctcaaactatcctcttcatattatacttttacataataggtattttataacaataaaaaataatttctaaaataggtgttttataacattaaaaaatagtttccgcattctgaaataggtgtttcataataataaaaaatagttccaagaataagtgttctataacaataaaaatagttttgtcttctaaaataggtatttcataacagtaaaaacatagcttccgaaatgcctattacataatagtaaaaaataattgttgaaaataaaaaatattttatgtattccaaaaagcctattctgaaataatctatgttctgaaatgaccattctgtaagactactatataacttctagaatcatgtctatagaataatggttgaaaataaaataaaaattacaaaattgttgttccggaagacaaaataccatattccagattacattcttaccttcaatgatgacgtgcaaaggaaggaggagggggaggacattctgcggcgtcatgacttgtgggatggaggttgtgagactgtcgtgaagaaggtgaagtcgtgggagaagaagttatcattgcgggtgaaggagatgtcatcatgggagtaagtttggtattttcaaacaaattggaaagtgcataatacacatatggagtgcataattcaaatgccaagactaggttgagttagaaaaaaaaattggtaacctggcttgacttgatgtaaaaatatattggactaggatgatttggactagctgaaattagcagctttatcaatgcatagtcctcttccaatctaattcgaccataaaattatcgtcacattaaataattttacatttataattgtgataaatcctagttagtgactagttattcctagtcatcatgtatagatttttttttctctctttatggtgatgcatcaagattataaaatggattcaaataaaacaaatcttaagatattttttaatgagaaaaaaagattatgcattgatttacattatcgtccaattacaatttatcatttatgataaatttattaaatttttaaaaattatcttaaaaatcatgcaaacaataacttgtaatgaattacaatataaaactattttatttacaccgctgtttcttaattaaattgtgtgattgttaaaggttttgaaaaatagtccataattgcaatttttactacaatgttaaggtttatgaagtcttcacaattgcaatgcaacagtaattgtagctccattagtcgtatttgtctaaaaaaattcacaacataaaaaatttcgacaaaattacaatcacaatcatgactgtaatttaaaacctttacatgctactgttaaattatgtcacaatatgcaaaatctattttctaaaattttagcataccttaccaaaatcacttgaattatgataaagcagagggaaaaagaaaaatgtactctgatatgacatctcctagttttcattatgcaggtgataaatatttcctagaatattacaagcaagtagtaaacgaaaaccaaggaatctaactccaacccccatgtattgtacagactcctaaggtactatcaacattaattccttttcccctttagcatcattgtccaactatagtaaattttccagtatgcctacaacatatgcaagtctcttgttcccacaactaagtgttaataaagagaaaaagaaaaagaaaacctttaaaactcaaatgacaaactagttaggaaaattgacaactttaccaaccgacaacattaacacatgcaaggcacatgtatagagtcggctttttcttttatttgttctttaacttttcctttggttctttggtagtagatcactgcttttggaatgcgtttggttgctttgcttgtgcaagcatttcaaccacttccctcatagttggtctctccacactttgttcctgaacacatagcatggccacaaagaatatctgctttgcttcatctaagggaatgtgacatagcctctcatctagaatcttcaccactttgtctttgctccaatttgtttgcaacttggtccattgaacaatgtctagaccttcttcaccaaaattccccactggccttctccctgttagtagttctagcagcaccactccaaagctatagacatcacttttctcatcaactttcaatgtgtatgcatattctgtgatatataaatcaaaatcagtacaccataatagttggctttcacattttagctcaaaagttaaagtaactatgcctatgtatgacagtacaataaatgtcattgttgaggaaaaaagagtttgagtataaaatataatgatgatgatggtgatgatgatgatgatgaaaaagactggctacttaatagttttataaacaaacaagggaaaagctttatttataattttcaagttaaccaattaaatttgtaagaagacaagttagtggtgccttgtgcctgtaaattgttcaattttatttttctggggtttggagaaagtaaatattagatctcaatctggtgccttgatgaaagaagcatatgcttttggtggctcttatggatatgttagtcaaaaaaggatggttgtgattggctttggtttgaatacgggtttacggtttcaaggcatgccaaagcacaaacccagccggcggatccatatgtagttgagggtgggctgatgcatcccctcatttcaataaaattactagtatttatcataaaatattatattttacatctcataattttatattttacaccttctaattttatgtatttgaacctccttaccaattcacatgtaagagtaagtaaatacatcatcttattttaataaaatgcaaaaaaaatatcatattttgcaccccataattttatattttgaatcccttaattttatgtatttgaaccttcttaccagttcacatgtaagagtaaataaatgtactatcttattttaataaaatacaaatatttatcttaaaactttatattttgtttcttttatcttcgtgtttgaatccaactatctcatataataatgataattatcaatttttattttttaaataaattgtccccaatgatccagggtcctagatccgccgccgcgtggcagttaaggtgaggaaaagcaaaagattgaataattttccattgtgttagtggagccttcgaccaatctagaaattcacgtacatgcagggataaaataaataaaatatttttgtgctaacaaaaaacagaaaaagtatattaattcttctattcccattgacttttttactatgaatatttgattgttaaatggacctgaaataatcatctctgttgatatcccttgaccttattaacccaacccactgcagttggcctagtagtgaaagttttggataatttgcacaatattctaagttcaaacttaactgttgtcattgtgcataaaaatacaaataaaactcttgaggccttgacctcaatcatttcacttggtcaaccttttttggggagccaagcaacaatgtctcctaaacttggaagttagagtgtatgtaaccaatataaatctactagaagtagttataatattgtagactaactgatttatatatttaaatattaaaattaagtacctggagcaatgtaaccataggaaccagcaatggaagacatgcactctgatgtcccagtatcttgcaagaacttggcaagtccaaaatcagcaacatgagcctcaaattcagagttcaataatatgttgtttgacttcacatctctgtggattatcagaggggaacaatcatggtgcaaatagcgaagcccttttgcagcttctgttgcaattttcagcctagtatcccactttagaaactctcccctcttcccatgcaagacttcacctaagcttccatttggcatgtactcataaacaagcaaattggtctctctatttgaacaaaatgccagcaacctcacaatgtacctgtgcctgattcttcccagtgtccttatttctgctgagaggccattatcatgagaacatcctttgttgattcccaagagcttcttcacagctacttgctctccatttgacattgttccatggtatacaaccccagctccaccccttcctatggcattgctttcctttatgcaccgtatgatgtcttcacttccaaattcaagattctgaaatgttgtgagcttccatgaattggagtgccttctttgctttctgctcttgataaaggccaatgttgcaaatgccaatgaacaagccaacagtgccactgcaaagagaagcttatacttcccaggaactccaggtcttgcactgccactgtcttgtgactccaatactgcatttgaagagtgtttacatggattcagctcatatccacagagccgaggatttcccacaaaggatgtaaagttaaacactgagaattgcccctcctcaggtattgaaccagagaagtcattgtgagaaaaatctgctgaagtcaagcccttcatggccccaagttccttgggaagactttggcttaggtggttccatgagacattgagatagttcattatgtggatttgagaaagctgaactgggatagggcctgatagttggttttggctcaaatctaaataggtgagcaacaaacagttacgtatctcgggaggaatactacctgaaaaattgttgacactcatatccaacttgagtatatttttcagcctccctatatctggagggatttctcctgagaatctatttccatgaagcagcagaatttgcaagttgggaaagtttccaatggaaattggtagagagccggataggcgattgttggatagattcaactgtccaagtttagagggtgcagtgcttgtttgttgtggaagccaaccactgaggtaattgttctgcaattccaaaagggccaactcaggcaagtaaagaaaaccatttggtattgatcctgtcaaatagttctgtcccaaacgaactctttggagtgtgtagcattggccaagatcagcaggcaaagatccaaacagaaaattgttgagcaggatcaaaatcctcagcctcctcccaaggcatagagatttaggcaccaatccagtgagcttgtttgttgacaggtcaagctcggccaatttgctattctggccaagccttgatggaatggcacctgtgaagttgttctgccaaagcttcagcacttccaagttaggcagctcagcaatgaaaggtggaatttcaccatgcaacctgttgatgaacaagttcaagagggtgagctcatgaaggcctgagaactcattagggatgtctcctgtgagctcattgtttgacaaatcaagacacttcaggctactcatgttgcctaattggggagggattgagccactgagctggttagtttgcaagaagagagtgtctagtttgatgaggtttcccaactcagctggaattggacctgtcaagccacagtttgcaaggtcaacttgagttaaactaaccaacttaccaaactcaggagggattccaccatcaaactgattgtagtatcccaagaaaagctgtctcaggttagtgagattcccaagctcaggtggtatgagacccctcaaatcatttcctgcaagagacagaaagttgagctgaaccatgtctccatagcttggagggatttcaccaaagaaatagttcccgccaaaattcaagctattgagcttggggagctgagtgacaccaagagggagggagcaattaaactcattgtcataagcatcaagcacttcaagctctctcaactgagaaaatttccatctcatgtctccactgaacttgttgccggatatgttgaggaatcttagcaattctagcttgtgaatttcactagggaaccctcctgagaagccattaccagcaagtgaaacactcacaaggctccttagtcctgtgatggaaggtgaaagtgtgccagaaatgttgaagttggatatgtccaatgacaccactgacctattcttttggtcacactgaataccctcccaggtactgcaaagggacatgtagttagacatgttccagcttctcaaagaatcagtgttggcctcaaagtcttgtttgagagaaaccaagatagaggcttgccttctcaaagacatgggaagagaagaaacagaagcaggccaagttaagcacaaaaggaggagtacaagtacaaggccaagagttacagttcccatttttgggattaactagcttagaagttaaggatatgcagttggaataataacaacaatatcatagagttatgctgaatatgaagtagcaggtggtgagagagagagagtgtgtgtgaggagtgttatgtgttgtaatgttaagagctcagaggtaacagtgttacagcatccaatgtcctcttctcttttccctctcttcttttctccgcacacaaacatacatacacacactactttggtgtcatctctagcttttaaaaagcaaaagcagtgtttggatagaaaatgcttaaccacggaccgtttcacaacccagttaaattttatttattttttattttttcattttatttgtattctgtcggtttttgagcctagtagcaccacttcctttagctttttctttctttctttgtttttctttttttgtttattcataaaccaattccaccagagcagctgatgaatcagatttggatgatggggatataatcgtagaccatattatagataccaatcatgggggagaataaattgatacaatgtgcatgctgagtgtacctttatttttttattaatttctggattttgaaaaagagaatgtggtgggggtgtcatgaatggaacttaatttttgttttaataaatgagaaattacaacgattaacctctctctctctctctctctctctatatatatatatatatggtcatagaagctaccgtactatatgtcataaatcatctatttcatttcataggcttaaattattgaataaggacacctgaatgatttgtagaaaaaaggcatatctctaagagactaacagaaattgtatttatataatttctctgtgtacaagaatggcgtgataaaatagttgatgtgatgaaaatagataaagaaataacattgcatggatgaatattagatatggctagcgttatgcatagaaggagaaagaaatttctgagcaacatgaatattagatatggctagctttattcagccaattcgaaaaaccattgatgtttcataacatggttcatgcttatatgaaaagagaaaacaattatcagggtatcaattcatgttagtaatcagaacacattaaagaagcacgtgttcactttggcatgtccaaaagtttatttaacgcatcattaatttaaaatcaaggaatcataaagaaaaaagttgttttcatgtttgttatgctcaatcagaagatgaagttaggaatcatcttttaaaatcgatcgaggtccttctccgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacagagatgaaaaaggaaaagggaatgaaatttaaagtatatgatatggttgatccagccacatcaaaatgtaattttaaagaacttggcaccatcaggatcaggccatcaacataccaatcaatacatgttagatcccaattgctgaactgagaaagtaaatctcagaaacatatgttcaattttctctttctggggttttgagaaagtaaatcttagttcccacttcccaatcctagtcagcccctccccaaaaaaatgaaaatgaaaataggaaaaaaaattgatgtatatgaattgagtggcagccaactcagaccagttatagatgtaatgaacgagacaatcttcatgatttaataatgaggacatgaggatgcaagaaagcaacctaggtcagctcataaactccaacagtttaatttctttttaggtggataccattggtcccctggacccctttctttctttgtatttagtttcccccagtaagaataaagtacattgctatatatcgtataataataataaaaaatataaatattttttacattatcatctgctcatgaacatgatctgataaatttattaatttttataataattatttttaaaatcatattaaaaataatttttaattaattaacaatatattttttttttctaactagttgttagtacaatgtttattttatatcaaggtcgagatttgaattctaaagcattgaattaagaaacataagttattattatttgtgtcaatcattattgataaaaaaaaaaaaactttacaatgtatgtttgttaaactgtaataatgataataattttaaaaggtacagtgttctacaaggagcctcgcagcctcttttaaccctttcgctttacaccctaacgtgaaaaagaaaaggcaaagccatcgattcttcttttgagaccatgttgggatccatcatattgatctcttcaaaaatgtaaatttctcgctacaaaatgtggaccagtttgaatctttctttttaccataattgtattttgatgaccaattggatggcaggggaagctaatattgggagggtgctatggttgaaattgaaggcataacagttggggcctcatagagtgattggaaaacatgctggtcccatttctgggaattccttgttttgttttggggtagtggagttaggacccatttctagcattaagccactaaaaacaagtactttagtttaggcacactttctgcttcagttgaagatttggaagatggttgtcctaatcttggttccaattgggtaaggttcgtggcatcatataatgtataataaattccaaagtggtctagtctaacctgtgctgctgtgcaatgggataataatacatatgaattattgttatttatatataaggagcaaaaacagcactgggtacgggtctaaattgaaaaatcacatttagaccttcctttcatgcacctcatgtttatctgatctcacccactgagcaaaggggtcgtggcactggccacaacggacgcagaagctaaataatggcagcgatatagatatgcagagaaatcttatttgtcccatctaagattcctagtttacgagccctctgtatatagatggagatttgcgtgtaccagctcagctagtcacgctagataacacgtttaagattttaaattttgaattagggtctgacaaattacatacgatggacacaaggaaaaaagtttatttttttgttatttcctaaactatgggacaatttattgttccaagtacaaaatcttcaacaagcaaaaataatcatttttattcataacttgataattatattttcttttttccactacaatctttagttatcaacttcatcatcgtcatcatcattactatcatatttatcattattattgacattattttcaatatcgttattgttactattatttataacattatcattgtcgtcaccacccctataattgttatcgtcaccattcctatcactaccaattttattattgttgttgttaccattaccctctttagaatcatcataattggtgtcaccattacgtcatcatcgttatcataattaaaaatgtgacaacttggtggctaaatatgtgaaataggagaaattatgagtaaattataaattgtacttactgaaaaaacaaatgttaaatgctctaaaaaatcaagtttgaaagtagaaagaaaaaaaaagttaagagaaaaaaaatgagaacaataattgaatttggcaagcatggaattgcactaaaaaattgtaacactagaaatgctgcttgtgatattgtccaatgcataaactttatggggtattgagatgacataagagtcctttatttttccttttctttgattttcttaccttgtcattgtaacctctaactcaattacatctctttaaagaccttgtgatttgcttgtgtttatttggttactagtggagatgaggttccgtacccaacctatagtaggacactttgcattgagaagttgagtaaaacggattttatcctaaaacaccttagtgaagtgagatgagtgaacttgtctttgcaatcattagttttggaggatgagcctctaattggactttatttgattatttgcataataatggttatctgttgctttttcttatacttgagttatgatatgatgaatctttttattaaaaacttttgctcatgataattgcttgaggacaaacaaatctctaagtttggggttgtttgatgtgttacatttagtcttttaagtgggaagcattttagttaggattatttgcattattggttgtttaggtctatattttttgttcattgcattgcattttattcttttgtcaaacttgttatgtcgtgggtgttttcacgttacaaaagccatgttgactagaccttcaatgctaaatgaagcttttctagtgcatgttggatttccaggattaaacttgatcatcaggaacatgggctacaaagtattgatcgagaagagaaaagccaaggaaaaatcaaaagctcatttaagtcgttaatctctaagtcaaaacccttctacaaagtttttctaagttatttaaagacacaaactaaaatttgttcataccaaaatacactaaaacgcacaaaaataagaaaataagtcgtcaactaaaggacacgctcgtgccaaatttgtcaacaacctgatcaagaaataaggggcttagcacgcccgtgccactaaatgacacgttcgtgctagatgcataaaagcttgattgcgacataatggacttggcacactggtgccagatggagccattcacaaatagctctattttccttccaaaaaggtccttgatgacaagtttgatcctaaaagtccaacatgcactagaaaatatccatttagcaccaaaggccaagccaacatggctcctgtacacatgaaaacacccacgacgtaacaagttcaacaaaaagaataaaatgcaatgcaataaacaaaaaaccaagacctaaacaaccaatgatgcaagtaatcctaactaaaatgcttcataattaaagactaaatgcaacgcatcacaccaccattgttgttattgccaacatcatttgtcgtcattgttaccccaattgccattactatcacaatcaccatgaagataattaatatttatttgatcggtattaagatgaatagataataaatatgaattgtattaagataattaatgttaaaaagggtaatatagtaaatttcacattattttgactatgtaatccaatatccacaaacaatgcaaaaggaaaaaacttgtcatataacttatgtgtttgttttgtattgttctccttatgctattctttggtatgtatcaaaacaaatccttacgccttgtttcgtagagaggaaaaaaaatgaatgaattgaaatacgtgagaagtaaaataaaaattaaaggtattggttgaagataatagaaaataaatgaagagaaaccaacttttttataaatgtttccatcctaatcatatctaccaaacaaaccaacttattttcatctcttcctatcctctctaatttttctctatcaaataaagtcataatgtgatttacatactttaaaacacgaatacatataattacacaaaatgttacatgtttcatagacaattttaactagtttagtaatttataacttatttggcaagattataagtttatttgactaaagtaaacaagcttatctatgacgaagatagtttcattctaacttaacaagaatttggatatcatgatgaacccaatacttatttttcatgatgtatttatggaccagagtttaattagtttggttaaatagttctgggttgaatatgatcataagcatttttttcttaaactccatactattttacccaattgctttagtgaaaaaatgttatgtattgacagtgtaaatttttttatacagtcatccaatcacaatctatcgtatatgataagtttgttgacttttacaataattatctaaagtaattcaaacgacaattgatgattggataacagtgcaaaattgatttataccgccattgcataagcattaaactcatttcttaagccttttttaacttgtagtttcatgactaaactttgcaaagctttattaattattggcttaaatatgtttttggtgcttgtaagttgacatttttttaattttagttttttaagttgatttcttttcaattttatttcttgtaagtttttctttgtttgattttagttcttataatataaagtttttcaattttagtcattttaaccttcatattctagtgttttcatttatagtctccataaattcatacttatagagtccaaaatttttaaaaatgtaaacttacatgaattaaaaataagtaaaatatcttatagagaccaaaattttaaaaacacaaatttttagagattaaaattataaaggtaaacttagatgaataaaaaataaaaaatgctaaaccaaagatatatttaaaccttaattcttactttagccgatgattgaaaaaaaatagtttaacctggatagatttttatgagtaaattacttattaaaagctctcatatattgtctcctacaatataatattgttttattaaaaaaattaacattatactgttcattttaattattccattatttacataatttacttatattttaataaaatattttgaaaaaattataagagttcaaaattaattaaaaactaaaatatgattatttaatagtattttttgttaacaatattatttctagaaacaatagaccagaacaagatattttaaatttgtgagactaaaatgaaattttaagatatttttaaaaactaaaaccacatgttactaacttaaaatttgtcatataacttataaattagaagctacataattgtttttcaattttatctatacatttataatcaataactttttatcttatattaatactcgtactttcaataaaatatgattacaagcttaatcatttcactttttaatagtatatttttcttggtaatatataatgatatgaaagaatatgtatacatgctccacaataattaaataagaaagacatacataatgatattaaaatcaaatcctatcgacattctttaaaaaaatatatttatcaactgtgttaaatattgttagatttttttatagactagttttatgtttgaatattttttaaacattcataatttttttaaatcttataaatttataagattcttttaaatcttaaaatttaatgatacaaatcttttaaaattcaaactataaaatcttcatcataattttttttaaagaaaattatataagttattacatttttccaagtcctttaaatttcacaagaattatttatgcttaatttaaaatccgaatctaatacgatctaatgtaaaatgtgtgattagtatttctctaatagtatattttaaaattataattttcacatatttaaaatgggacacattattattatatgtgtgtgtggttttgattttttaaagtgagacaaatatttttgtgaataaaaaacacttataagttattatcgtgcattttctctaagaaattaataatgtcaggggacatgcatgatgatccgaattattttgagtgaatttttgaaaatcaaattagacatttactgttacaacgaaggtcgtgaaacctctaccaatattcatcaagatgaaatatattctagcattttttttagaagattatagtccatctgtttcattgaaatgtgaggatttttatatatatataataataactttattttcactgctgtttagtgggctagatgtgaggcggttccggattattgggtctagtgatggcctttgttatttgcaccctgtatagctaagtccacacactattattgttgatttttttttttttttgaaaatacttttgattaaacatgtttccattgtgtattgtgtatttaggagtgtgtgactcaccacaatattctgtattgcaccatcaattgttgtgaaaacatagtgactggcatgtcatatttctaaatgacataattattggactacaaatattattattatgtcattagttaatattatcatttaactataaagattaaaatcaaaagtattaaattttacatagcctacaataaaataaaaaatttaaataataaatgatcaaaatcaaaataagtatattatttacaaaccaataatcctatttaagcattttttattaaattaaaacatgaaatttgtcttatcagaatcatttataagaaaaatatgaaaaccaactaatgtttgaaccaaaattagatgtaaagaaaatgaaaattacatgaaaaatgagtttcatgaataattaatttttttaaaaaattaatatcatattcttttttgattgctcacgagatttatctttcacatgattttggttctggttgcttttatacaaataagtttaataaaataagtttcacctcttgaataaattgaaaaaaattaaaatagtgctaagaaaatgataaattttgttgaaagaactaacatgtttttaattaaataaataagaaaaattagtactattattattttaaattaggagactaatttaaaaataaataaatcaagagcctcaaattcatctctgaaaaaaatgcaataggcgcaccggagcagtaagaagactcgcacacagaagattgtcccacccgccaaatatctcctccatttccatattctattctcataaaaccctaaaccccgaattgtagtgtttagggtttccgtttccattttctcaccacaccatgttaaccgcaatcctcagaagaacctgttccactctctcaaggcgcggtttccccgccgccttaatctccgcctccacctccaccgccactgtcggaaaccacttccggccaccctccgcggccttcaattccagaaccttccactctaacgctggccccttgaatttccgctcctcttcatgtcatcgcgcagaatacgccgtcgacgatttcccttacgaagaaagctccaaagggaacgccgccgacgaaggcctcgagatcgcgaagctcggaatttctgaggatatagtctccgctttggccaagaaaggcatcaccaagctcttccctattcaggtttgctttgcttcctagggtttactcgtcggtgcataatatgatccatggttgataattaaccctgtgtagtttagactttagatgtttagtaactttgagcttctgttaattttttaattaattaattattttgttaaattgtagagggctgtgttggaacctgctatgcaaggtcgtgatatgattggtcgagctagaactggaactgggaagactcttgcttttgggatacccatcatggataaggtcattcagtttaatgctaagcatgggttagttctatttttttttttttttatgatatcgtcatgcttatgtttcgctattacttgaatttgtaactttttctctgcgtgagttaaaggtggactatgcaattgatattggtgtggatggaatcatggaaaaccttgagttgttttttaactgtacaagtttttttgtggttgatgtggcaggcgggggagggatcctttggctttggttttggctccgaccagagagcttgctcgacaggttgaatcggagttctgtgagtcggcacctaatttggatacaatttgtgtttatgggggtacacccatctctcggcagatgaggcaacttgattatggggttgatattgctgtgggaacacctggtcggattattgaccttctcaacagaggtgctctaaatttgaaggatgttcagtttgttgttcttgatgaagctgatcagatgcttcaggtgggctttcaggaagacgtggagaagatcttggagaggttgcccccaaaacggcagactcttatgttctctgcaacaatgccatcttggataaagcaaatttcacgcaattacctgaataatcccctgaccattgatcttgtgagtatgaaattctattttaggctattggagaatgcctttaagctgttgcaattctgagatatcgtttagttaaccggaatatgactcctctaaaaaaatataatgtagaaacaccacctagtatattaagttgtagggcacatgaacctcattgagaaataagtttataatatctaaatgtacatatggtttgtgcatgtgtgcgcaagtgagcacatgatagttacgttttaattggaaacttattggtgctgtaggttggagattctgatcagaagttggcagatggaatttcactgtactccattgcaaccgatttgtatgttaaagcgggaattctttcacctctaataaccgtatgccttcggaaaccatcatttcttgattgctagttcttctgattaacgatttttactatcatttctgtttcataagaagtaggttttgaaaaaagttgttatttttccatagtttttaggggtgagtcttggcccaatggtagggttggcgccttgactcgaaggtcacaggtacaaattctagaaacagcctttccgcttgaggtggtaaggctgtgtacatctaggctccttagacccaattaggtatagccttgtgcactgggtcacccttttatatatttttaagggtttactatctttttagttcctaaactttataggatttctgtttttaatccctgaacatttttttactgcttttagtccctcaatttttttttccgttccgacttttagtaaaaataaggatggaaaaatgttaagtgactaaaagtaaggacagaaaaaagtcaatggacgttgatcagtagaaaaaaaattcaggactaaaaacaaaaatcctaaaaagtttagggactaaaatgatagtaaaccctatttttatttagaaaagctagttaaggaaacttcttgctggattttttttttgtctctcctaaagatatatcctttgttaggaacatgcaaaaggaggaaagtgtattgttttcactcaaacaaaacgtgatgctgatcgattatcatataccatggcaagaagtgttaaatgtgaggctttgcatggagacatatcacaaggtcagagggagaaaacacttgctggcttcagaaatggccatttcaatgttttagtggcaactgatgttgcctcacgtgggcttgatatacctaatgttgatcttgtgagttgttttatttctttgaaatagttaagttggctgacccattggaattgtgtttattgttattgaattgcaagaaaactcttatttttccatgggtttttctgctgcttatcagttattattaccgttttcttctcaatatatctgagatattaattacttatgtaaggacaaggtatgcatatgataactcacttgtctctgattgattactttttagaattttctctaatttttagagtgggattctctacatttccgacttgtatttattttcatcagatgttctggccatagctagtatgttgttgaaatcaatgaatagcttctgatatttatgatgctgcatttcctcttaattttttgagcaaatttgctttacaaaacaaatgatgcattttcaaaagatgggctgtacactttctgtgtattgatgatattattaggtatgtttccatatagaacaacatattttagcatctgatcgttcattcttatctgctttcagagctttaaatgttcgttcttactttttagcaatggagcaatactttaggtgtattcttgccaatgttctgtccgtggttctataaatcttggacctcagattttattttgttgcttgatgtgttattgttttgtattttgcggtctttatcaatattctatgctttactttgtttaacatgtcatgtgcatatgcaaatactttcatatagaaaatattgttaccatgttattcaattttttatatgtgaagttttaacttggtttccttctataggtaatacattatgatcttcccaacaattcagagatatttgttcatcgttctggacgaacaggtcgtgctggtaagaaaggaactgctattcttgtgtatacagaagatcaatcgagggctgttaagcttattgagcgtgatgtgggcagtagatttacagaggtgatctcctggcatcctatcaatttctgccctttttactggaagttgtagcttgttaattagtaattttcttgtgattgaaattgaggataatctatttttaattactaacaaggataacacaacctcctgccttaaatcccatccttcctgtgcacaatgagatttaaacctgtgaaatcccaagttaaagcagttgatgttgaacaattagagttcccatgtagagacttgctgaaatagtttagtattagtttgcgagtcaggttggcaggttgcaactaatactggtaaaactttagttactgaaaatcttaattttctttagtactcttgtatatctaagctgccagtgaactactatcctacagttattacttattactactgttttttattttttattttttatactgtgatgtttgctctatgctaattacattataggacagtattatttatttatttataatgattaattgattgctttttattcctatattcgtgtttatcagctaccacggattgctgttgatagtgcatcagtggtgatgggtggtggcatgggtggtgggagatttggttctttcggaggtaccagggatcgtcgatatggtgatacgggttttggatctggccgttctgggggctacagtaaccccggttctggccgctctagctttggaaattccggtgaaaggtttggtggacagaattataatcgttttggttcgggtaattcatctggtgaaatgaatagatatggtggaccaagctctggtcgttttggatcatctggtggctttggttcaggtcaatcaggaagtagatctggcggatcatccagtgggtctaggtttggtcgctcagatgattttgggggatttggtggttcagatcgttcgggtggttttggagattttggctcaggtgagcctagtggctctggtggttctcgtggtagtaatcagaacaatagaagacctttttaacttaattaacataaatataaaaaaatgcaccatccttatttatggtggcttagttcttgtagagtttgcgtctgtcatttcctctaaaacttacaggtttcttggctaatccttgtattactaaggattttagaagacagaagttctacggccattggatttttcttttcttttctgggacttttggctcagtctcaatgtgtatgttctttttgaaacatgtaaaaggagaaaaaagggagggctgtattctgcgggttccatcatctgccatagctcattacttgtctgtatgggcaacatcagcacgggcagttttaaagaggcagctgtatttatatttatgttccttatagtagtagtagttaagggaagatcaaatgtcttggtaacctgtagtgtagggtgctttgctgttttattttatactaaaaatctattatgcaagaagtttctcatctactatgtaattttggttatcaaatatttgtttttcgccccttcaccctgggttacataaggggtttgattaaataatttgggaatcacgttgtttaaatcctgcctttcccggtgttcgtattttgcctaacagttgctagatttcgttgatccacaaggaagtaatgaaatgtttataaaaagaaaaaaacagcaagaggtagctgaaggagcattatgagcattaaccctgcacgtgagagaaaaataggaggaaagaattgtagaaattttatgagtttcattatttgcttgaagattggagggaaagtagaaactattgacttttaaaaattccatctttttttcaaattattgttccagcttaaattttaaaaatctgtttttctttttctttttctttcctgtcatttgaacgaagggtaaatgtaggcgaggaatttcttagtatttgtttgtatgagcgttgtaataaaattaattttgtaaaattgatattgtttaaaattaattttgaaatgatatggtttatgtttgtatactttgttgtaggttaaaagtaaaattcaatacaaaattttgaattcaacactcaaaatttttgatccacaattaattttgaattttctctaacataaaattaaatatatgaaaatacattcaaaattaatttttcaacgtcaaatcaaacacgcacttaatgtagcactaaaaaagtacaaccccgttggatttaaaagatttcaaacttgtgttttggattagaattttttgcattattaaattcatatttttatattttttaatacttttttagaatgataatattgtctgacggaatgatttaatctaaagtaactcatttcatggggtttagtcagagtgctaaaataaattcattcatcactagatgggatgatttaacgtaaagtaacccatctttggattttttttataaaaaagttaatgttttaaaatgctagtatatatttaatacattttaagttgttaaatattattattttctgaataacttgtgttgttatgaggtttagaaatttctaaaattctaatatttcagggcgccttttcttaaaatataatttttgaaaataaagttttcaaaaccaaatgttaaaattaatctgaagataaactttattaaaaataatgaaagtatttttttctattccaatttctctcgcactccattcttttttgttatcccgtacgatctttcacataaatttgatgattgtcaaacaatacttaactgcaggaagtacattctaataaccatttcagtaaacatgacaacattttatatttaagtaatttcttttcaaataaatagaaactagtttaaaacaaattttaactaaagtaaatttagcttaaaattggttataaacaatctcaatttataatttttatgtaattttacatattgttgatgcgtgattttgaattttggatttatgcataaataacataatagatgaatctttaaataaatataggatagactcatgaccctttaaatggatataaaatagattataatatcatcttagaatatgagtttgaatataactcaccttcaaaaattagttcatgaatttaaataacataatagatgattctttaaatggatataggatagactcatatgattatttaaatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaactagacgaaacacacaaatatatagttaatagtaattcttaaggatactactatactggtgatgcggtcaccaaagtaatctgctctagctctggaatttgtctcgtactaaaaggttggaagataaagaatgtactgaatacaaaaactaatttgtggcaacatcttttatattttgtataaaccattgtaaaactcaaaactataaaaaaaaatgtgctaatcatatagaataattgcatattaaaaaaatcatgttgagaaatatcttgaggtaacagttttatccataaatgccatcacttattattcagcaaagacaaagctaacattttaatacttatctataaggaagtcagaggacgaaaaagaagataaccgccattgacccctttcaaatctaagtaaaattatagggccaacaggggaatgatttagctggtaaggatcaaccaagtaaacctggtgaagcttaggtttagtttttgcagccaccaatactcctttctggagtgacaacacccctacctcctcttttcctaaactctgatgatttaccaaaaaaattatgttttggatttacccggaaaaaatgtacagattatagaactatttatacaagaaatcaattgctccagatcagactctaccagcagtttgaaaaggacaaagtcaaaaaagaaggaccaatcaccaagggatactcaaatcatgctggcactccgccacttcttcatattcttctttcgccgagagcgaggaaacaatagttgccaaatttgtttttcagctgcatttgcattggcggcctgcaaatgggagaaaaaaaatccattaatgaatttgaaaaatgccatactggacatttcttctttaagcaaatttatacctatcgccccatagaaatgcttatgtaggtccaagcctatggagtgaaatagcctacgtgattggctcttgctaaccattagataaaaatgccttaaatgaacagttgtggactgtaaaggcttctttcaagtgtggtcaattacacaaacacaacagtatgttccctcttctgatcacgtgttcatcaccttaccccatcccacaaccaaccaatgacaatacaacacatttgttgcattttatgcagcagtggccctggagatttgtacttgtcccttctctttttcatcttcatcctaactaaaccgttaattgagaagcccacttcctaaatattacaaaaaatacatttttggagaatcccgttcaaattctcttcctgtgtgctacacaagcatgtgatatgtgtgtgacaaattagttgacttagaaccttggacttgtagttttgcttcaaatattattataataaattcatcaaataatactgctctagttacaaaataatgccaataaaatattttttgggctattatataacattggatttattttaacattagcatttaagatgccacatcaaacactggataacataaaaatcataagcttcttacacaatcaagcctcaaattatcccatgagagatttttagaatctagattgttttaataactaatagacatgttctcaccaggatgttcaggtgagggtccatgacagaatcaatctgaaataatgtacactcagttgaaacccacaacgcttacctggactttgaatggaaaccgatgagtttttacttctgcacctgaaagaactctaacatccacgccaaggctgtcaaccccaaccaggtaagctccctggaaaccatgtaataacactgaaataaacaactggctactaacagtagacatacaaaatcaaagtataaaaatataacgaaccaaataatagtcatttcctatgcgtgagtgttttgtttggtgtcatgaagggaaatgaataagatagaaaagaaaaggagaagtaaaggaatcatcactttccttgtcagatatcatccaatggaaaataagggaggctttccttcggttatttggtttcataaaggaaaagaatgaagatgtatgtaaataaatgtcaaattattttattaccctttatatgatgaaattgatttacttgaaagatttgcatggtggttagagtggggaaaaaattggattacctcgccataaagacctttcttcttgcaaagtgctttaatttcatcatcacagaatcgattgaagcgttccagaatttccgaacaagagtgtgcaagaatatcaggttcagcatcttgaaagtctagcacactaatttcagactgcaatttttgtggataggtagaacatgcataatttgtaatttagaataaatctcaacaaacttaaaaatgcttcaaattacagaaaaatatcggagtttggtaacttgctttctaagaatattttagtaagttacaccttttggtgtatttttaaaaaataaaattataacatgtttacacattctttctaaaaacaagtaggtgtcttaaccacatgggtgctaacatacacccacttgtatgctagcaagttgtgtgtgtataaataattctcattttaagaatgtcagagctataaatctaggtcatataaccatacatggattgtcaagattaaaggttatttagtggtcacatgactacttaaaatagtcatctgcattttttatattttttttaaatcttgactattcagatataatttaagaatagatagatgtagggatagaaatctgttttgagatacatgcctgatatccatacatggagtggagctcgattgacaggatctccaatcgatatagtgtcaaattagtgtctctttcatcatcatcatcactatttgagttaaaatcttcaccatccaaagattgaaaaggaaaaaaaagttaaaaggcaatttaccaattaatcaacatttttttttgtcaaagctaagatttcatgttactgaggaagaagaggctctacctcttcaagttacataaatgcattatgctcagagaactacaatgacaagcttcaagctttgttgttatattgatattgcaatattagattagctttcctagacaagaaccaatgagtaaaagtagctgaacccaaacaactagcaccaaagtttgagtgttcaataaagtaccacaactttagtcagctaaacaagatccttctgcaatatcaaactcttaggaagtacagagcactctgtcctctttaacatgcttcttcttcagaaatgcaccatggcaagaaagtatgatatcaaaagcatataaaaggtagcctacaaattaataaattactttacataataaaaacattaaagtaacatataaaagttaaaactggatcggtgcaaatgtgtaattatatcctttactccaacttccaacacaagaaacttaacattccccttcaataaaaatctatgctctacaaaatttaattttaggaatttatacagttatccatagagttgctctgataggtaacctatcatgctcttaattttaggtgaagttttgggaagatgtttggctaggtggtgaggagtcgttgttggagatgtatccgcgtatgtacagcatatctcaacaacatcatcactttatacatcagttggggtgtgcagcagaggggggttgggagtggcagctgcaatggaggagatttttcagggaatcggagattgttatggttgctaaattcatggaggacattgaaggggcggtgcaggccaaccagcaagacaattggtgttggggggcagattctagtggaagatacacagtgaccagtgcttacaaattgataagtagctgtccatcaggcgtgaataatgatggtctgttcaaggagttatggaaaatcaaagttcccaataaagtatcatgctttgcttggaagttgattcgggatagattaccaacaaagatgaatctaagtaggaggaatgtgcctctgaatgacgtaatctgccctttttgtagtaactgtgaggaggatgtgtcgcatcttttctttggctgtgacaaatccggcctctatggtgggaagcattatcgtggctaaacatcgtcggtgtttacccggaaactcctagagatcactttcttcagcacacacatggttatctcaagggcataagatctcagcgctggcaaacatggtggatgtcattgacgtggtgcatatggtaccataggaatagggtggtcttctcaaatgaaggtttcaatgatcaaaagttgttggatgatgctgtttttttctgctggtcatggctcaaaaatctggaaaaaggatttgatatccctttccatccttggccaaaaatataaggataggattttgtaatcaggggagggtggttttataggatattttttgtggaggggtacaaagacctatatagtcttatggactcctaattcttgcaatactgcagtattaggaagtattatggctccataggattacacatagtagggcatcaatgtaaatagaaaagtaccacttgtactcatctatatttaatataatacatatattttgctgataaaaaaaaatgctcttaaaaaactcaccatgattttatattaaaagtataaaaaggaaatttatagatcagaaatatcaaacttgaagagaacagatacctctccagtctgagatgtatacatcgccatcttcagtgtgatacatccatcttagatatgacttttcttcaccataaacgggtctaaggaaccctattatagaaacaccatttgaaggatggttcattcttttaacatataccatgttgttgatggcctataagaaaattcataaaggatcaatgttatttcttccagagcctatgaatctgttaaatcattctcatgctgaaacttgaaaattagttatcagttttcttcttttttttttgtgtgtgtgcgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttttttaagcactttgagaaataaattggatgaacagagtttgtagtatcagactgtccccaattcactggaatattaaactcctccatttctgaaacctgtttgcagaagaatatacttgtgatttgaatttctcagatgcataaaaagaaacaattagtaactaaaacaactgactaaatttcataatttaagcatttgaaaaggcaaacctcaatatcatcatcatcaaatttgaattcatcatcgttgccattattgaaaatgtcatattcactagcagtccttctattattatcatatattgggatgtccattccaaagaaagcattctgaagaaacacggacttagaatatcaatttcacaacttctatgtcaaagatagggatggaatgcaaaaataccatgacaaaactacttcagtttatcatccaaactacaaatttagctctttaatagttgttgcacaaagacagttgaatcacttaatactttaaaatgactacataatctctggatctatattaataatttcatataatttgaaataaagtatctcatctatgactggctttttattttgggagaagacatgaaatctaactgggagtcccaattacataaaaaataaagaaaagaagagcatcaagggaaaagtaggtgcaagagattagaagcctaagacttataagttataaccagaaatattgtgcacagaggtttgacagaaagacccatcacatgattcccagaagcaaagcatttgggggttcttaaaatgtttactacctgcaaattccatcaatatttttaaaaagagattaaatatttttttttttttataaaaataattcttatcagatgggaagacaaagaagtaaaagaacaaaggatatggaatattcattagagggaagaaaaaaaaaagctcaacagcagaacagctaagtatatttggccaatctcttagcatgtataacaaagaaatccctttgaaaacggatacaaaattcctaccacaggattgttggctccacaatccgccaaaaggtttgcatcatcagagatttcaaaatatatatctacaggaaaaaaaaaggaaacaaaagcaataggttataattataaatgtttattactgaatcaggaattcattaaggtaactaataattctcatttcataaacaaaaatatatgcataacaaaaagaaaacaaacctccaacatcatcaatatgatattgaaactcagcccatgaaatctggtcatgtggttcacagtgtaccattccaggaaatactagcaaagcgcttttattagcctaatgccaacaaacagggcatgatgataaaaagtatacagatacagccaaaatgcgcccagcaaaatggaaacatcatattatgtgtactaggtccgtagccctagatatcacaaattaacttgtttcatgtgcacaaaagcatataggcacaaacctctacagttgtttttgctatttcagcaggagagagtctagctggctgaatatcgttggaacctttcagttcttcaagaggatgataaccttgttcatccatgtgatcagaagaatcgggtatagaatctgagtagtctgcagcaacattaacctttgaaaggcacagatcatgccctgtggatagccaaaggaagtgtggtgatccaaaaaatggacttttgcacctaaagataaccaaaactattttcagtaaacaaagcattttagatctttcacgaagaataattacctggacaagaattgactagtgacaagaaaaaaacctatataaataattgcatctatcacagttttttgaattttcaaacaacacagtaaatggaatatttgattgcagaatcaggagaaggaagagactaataaaaatattttgagggttctaggtacttcatctgaaataaatattaggttaccggtagtaaaatcatgcaacaaaactaaaatcctagcatccatccaggattcatgtgttagggttataaaaataacttggactccgcttaacaatttgagttctagttaaagtgtgcgtaaaactaaatggattaaacctgctatgctatatagataattttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcactcaaaatagatgattatcatactgatatggatcatggatgcaaatacgtctaaaacatcttcccatattttcctagtctcgaattaaaaaacaaactgtatgatcccacatgtactataactaatacagttctataagcaagagaaagctgaataaggataaataatcatccttcatgtaatgtaagcaccttgtgctggcaagatcatgccaccttcggccatcaataggaagtttgattgaattgcttgtttttccataagtagagcaacatatcccctctacaaggcacacaatgttgaacaaagatgaaaacaccatccaatagaaagagcactcgaacacaatttaaaatctcaagtcaaagacgttaacacgtgtagtgtaggtaagtatctcaaatcgcataaaacaaaagaaaatctcaaaatgtataaaataattaacaatcatctaagctatatcaatcgaaaacaaaaatctactctgaatcagaattttgcactcactctcatgatcaaattcctaaaatctgcaattagccttaaatttttggacttcttcacaatctgaagaccgaatacattacaaaaaacacttttaatttattcatttgtttattttgctccgccgaactccacagttctattattgtaagagcaaatgaataaataatataagtcagcattcttcttctttaaaactcgattgagcctcataacttgagaacattttcaccaacgtatgcatgcacgagcacgaaaatttcttataaaggagtcgaagcaagtttctaaaattttgcagaatccaaacagaaaagagaaatagaaacaaaaagcagtaagctcattcgttttattgagaaatgaaataacgaatgagttgaaagagtaacaggaattcggaaattgaatagcagagaaagaagatacttaccagaagacgagggaagtgaagaagcagcaggaggtagaatagccatgaaatggaagatttgggaagagagggaaagtgctttttatatgacagttacagtgatagtgacagtgacggggcgctaacaaacagcgactctggcagaaacatgacgatggcgtgtgtgcgcgttgtgctctgtttgtgcagtggaaagtagaactcaacacgggcttctacttctgcttctgcttctgcttctgcttctcaagtgaacacaaaaatgaaaaacctcactccaactttttcgatcctctcctgccgctgcagcacgatcttccttgcatcctaaatccgaaccgttgattattttctatttcttgtttaattatgtgcaataattaatcaatggttgtgatttaacaaaattttggctccgtataaaattgggtagaaaatatctattttgcctgcttcttacctaaacttctaaggtgagccacatgtgcttcatgggcttgcttgctattggttgttattgctcccaacactcttgctattggtccttacaatataggcaagatatttttctctccaaaaatgtcatttttatagaatcatgatttccttattatacacatacaacataatcatatttttttacctccgaataacacaataaaaatatgtttacgttatgttataaaaaagaaaacatgttttgattgtattatgtataagggaaacatgattatattgtataacacacaggaaataaattttcaaatttaatttattttttatatttgaggtgttttaacgaaatagtgtttgtcgttaaatctctgcatcacggcgtgctgcgcagtcacacgttgacgcctgtctgtctcagcaagctcaccgacatcaccccttccattggaggttgcatccaatcacatatgatatcccttttcttgcaagccgtcaaaaatctggaaaaatataattgagagtaacaaatataaattacaaatttgaaagatcttaagaataaaaatcacatatgatatcccttttctttcattcttaaaactaatgttaacacaatcactaatgtactagtattttatttgcattttaaaaatattttaaaatagtactttgaagaaaaccgactctacaaattttttttttcaaaaaaaaatctcaaaagaatataaaaccatttatccgtgaaaaacattaggtaatttaattatcaattgtagtatatatgattttgggattaagatcttctgcctctatacaccaataaattactgatgccaatgtggaagatattcttttgaaagcaatgtgaaagattttagacattaaaattatttaattttttgtataaaatactatacaattatgtctaaaaattataaatggatggaaagaatttaacttacactctctcgtcttaaattttaatggagaaaacttgtttccattgctttggatcgagttaactcacattgagagaagttttccatgttatattttgattttttttttatgcttttgtatctcttttattactattgcagtattactgttaaaattggcttagcttagatacttttctggttagtttgcaacaagaaggaaaaatttcgtttagctcttaatatttcgttgtgtactttgatcccaacatgtgtatcatgccatgactcatgagatgataacctgtttgcatagttttattttgatacaatttgtttaggctggcgaatccttatccttaatctcaagcattaaacacaacttaattaaacataattaatctatgtgatgaagatgcatggataagaacacacagaaaatattcattcattattatttgcaacatgaaacgcttgttccacatacattcaacaagccgttttatttccttttttcaagaagaaacttccaaacatccatccttttaattgtactattgtcccctttgccctgagcttacatgaacactgtaaaaagaaagaagaagaaaaaccaatgtcaatgaaaacaaaataactaatgatgactaattagtatgatggattaatttttactaagataaaaataaagttaaggaaataaaaagaaagcttacttgttacaattggtgttctgcttgctcatgataaaacccaaatcaacaccacataatttaggaagtgaacctgccgtgttttctagcaaggaaggaaggcgaattgctacgtcgaaaaagcacttacatgcagccattcgttgaatttgtgttggtgctgatgttttcactgcattaacactttggcaacaattacacctgaagggataccatctccaccaatgaggtaatccacgcacgaaattaacaagttattcacttgtgaacaattgtagtcatttggtgctgaatttgttgtaattggtgcctctgaagctgtagcagctgtgagaacaaatacaactagaagagctaaaaatgtgacaaacactttcttcattttgtgaagctagtagtttctatatcaatgaactttatgggattaatttgcttgttttttatgggatgaattgaaggttgagaaatgtacgtgtgagatatatatagctacaaaagttgacgcaagcatgttcaagtggaatccacgtgatgtgctccaattgcaacaatttattaaagcatattaatgcatgagctagcaaacaaaagacaccgcttgatcaaatttgcatttaatgcgctgataaaataaatgcaattaatgtgaattcaagttctaagagaaatgacgcactgatcaaaaaaatttcaagattggctataaataaatgaataaacctgttttagactaagggtaaaatgatattttcattaaatacccatttattttccttttttttttcaaatcaaacatccgcaccaaatttagtttcactcttttctattttatttcactttaataaaaaaaaaatattgatttacactttatttcttatttatttgtctgcttttcttttctaactattcacttccattctttccattttcttcctcaccacaaaactcaatgataaggagtcactctcattaaaagtcattaaatatctaaattatatgaatttaacgttggagtagcgtaacttaataagcattaaattgttttattcttaaattaagagtcattaaatgaatatcttttttatagagagtcattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccacaaatattgataaaatttgtgggtatagagagtatgagatggatttttactcaatggaattggtgacgaggactactacacgtttacatgtatcagtctcgctctaatgtcatccttaattcaaacaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttagtctttttcacatctcttatatttcctccgcttttctatagcagtacttctttgtaaatgttactcttgtatctatatttatattgtttttgctaaatgctaagcatatctaaattaatatttgaatgaccataattgattagtataacctccttaatcattagggtaacttttggaattcacgtaattgatcagttgtttgtctctaatcaattggatttttacaaaaaatccacttatgtttttctaaagaaaaaaaatacaataacagtataaaaattacttaacataatgctcaacgaaatgaataaatttagggcatatttatttaaacgcaaaattcattattttcattgtgacacctcttaatataaaatctatgactgaaactaatttagacatacatctcaattacattcagtaatttgaaattatttctgtcaaaatcaattctactcagttttaaaaccaacaagtcttcattttgcatttcatagttaattcattgccttacattatgataaatcaacaaaagaagcccttggttgcccctgtcaatgcttgaaaaatggaaatatattcccataatctcaggagtaattggcacatgatccctgctgattgctgctaagctcagaacatggccaagggctaacttgatgagcaaatccagacacatcagaacacttccaaggtggagttctaggtcctgtcactccatgaaggttgatatcatataggcaaatatcagtgaaaggtgaatttctcaacccttgtatcaagccagcctgcaaaaccttcacaccccaaacattcttaattgtgacacccttcacaagtgggagagctttggcatcaaatttgtcatcagggtggtccccaacatcacctgagatccttattcccttccttgcttcctccatatacacatgagacatggttatattctttataaatccacccctgccagtgtttgtcttaatgtggataccaattcccatgttgtaaaggttgatgtgctcagcaagtacattctccaccccaccagaggtttcactgccaatagcaatcccagcaaatggagacgatccagttacacgccggatcgtgatgtcagagctaggacggccataagcaatcccatattcatcccatccactcttcacagccacaagatcatctccagtagatatgtatgaatcctctatgcacacatttgaacttgaatctgcataaacgaattgatatttgtatgaatggatatacaagggttcttttacttgtcataccaacaaaatggtgccataatatttcaaccaccagatgcctgtgggttttgcccttaaacaacagtatttaagtgttggtttattaactacgaaggaaagaaacataaatacagaactttagagtacttatcaaatttgagtgcagtttgtctccgaaatgaaacaagacatactgatcttagaagggaaaaattactataaccaaaatgcattgcttacaacaataaaatgagatcagttagtaacttagcatagtgtttgactatttcaattggttgtatctatttcactatttgcacaagatatggcatatttagaagaggtgtactctctaacagtcattcttacaaactctatcatcagttgaaatttattgaaattgtaaaattataagtgaaacttgttaaataagaagatagtctcataatttttaattttcaataaatttaaaaaaatgtgttgctagcctttctatatttagaaagcagttactacttacccggatcaatgccatcagtatttggagagtcacgaggagccaaaatcgtgacatatcgaacaacaacgttgctgcaaagaagttaagacaatatgcaatcagatttcagaatgagatctagttagtttaaagaaacaaagtaacaagtttataaagaattggtacaaatttgtttataaaattttcccacaaacattatggtaaaacaatgttaccaaagattaaataaaaaaaggacataaggaatgccatgaacacactttataaactccttatgacctaaagtggcatgcatatacctgctgtaaaccgggtgtatgttccaaaagggagaattcttaaagataacatttgaaataataatatctctagaattcacaaattcaactaggtttggtctggtaaactgaagagttccctgcctccacttattccaccacgcatctccttgcccatctattgtcccattttcacctatgaaaatatgaattgtgtgagagaaaggtatagtttggacacaaaatcctgtaaccataatagagaaactcgcaggatcaaagatttccactcaattatgaatatgcactatgcagtataaagcttggaataaataaaacatgcacagatattgtaaagcttttatcctttgtccatcatccaccaaacaatatacaagacaaaaaattgtcatgtaattcaagtatttgtcatgtgctgcacccttaggtgcatcaaacgcacctttaattaaatatgtttataaatattatcgtagtatactatgtggtctggtacaaaccacaaaatcagattagatgtcctaaaaaataggaaacataagatacccacctgtgattaccacatcctgaactccatcaccatggataaaactcatataccttcctccaggccgttcccttcctcttccataagatggcaagggtgcaatcaaaggccaattcaatgaatcctaatgaatcaaacaatgaagggaattaattagaaagtggagtccttgtccatctgaaacttatctatttgtttccttttttctctttaaacaataaaatgtttaagaaggaagaaacaaaggtgtttagctttaattgagcataccatgaaaacgttattcggatatgaatttattgtaatttttttatgtagataactacctggcgatgaattcattgtttttgggaataccaaggataaagaatgaagagttctgcattcatatgcaccatttcactaactatgatattcaaaataaatcaatttagcatagatataatcatcatcatcatctcagtttgtgttgtttaaccacacgaactatagtaacaaggtttaatgccagaagaataagtgagtaccccacttccacttgattatcaaagaaaaggacagtaattgtcagaaatccaagctgcgatataaataattggctaaagccataaatgtcatgcacatagtgccatgcattgatgaagactagacccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcccccacacaaaactttctatcctttcagcatggacccaccatagatcatggagattatatgtttcccacgatccattacaatcatctatagtccatactccataccaccaatcatacggataaacacgtacatatatggactcaattcattggtataaccataagcttttaattgtaacatctttttttttatgcacgggaacatcagatgtacaatttcacatgtactctttaatgttcctttctctctttttcctctattctcctcgttatatttggtagtcggtgaagagtttgcgaacatgattttgcatagcaaggtttctataaggggaaaaccttatgcaaacttaactaagccaatcaaaaggttacatacaacagcaaacttaatccatgtcattaatataactttataattagcaagcattccgtacaaatatttcagcaaatacaggatatataaatagaattgtaaacaaaaggctcataattaaatcaaaataattggaattacacatgcgtcatatcatttttaaggaagagtagactaaaagagtaaatcacccgcaatatagtgtatctaatttaatagtatgaatttctatgtttcggggagaaaagttagcataaaaatgaatttgaaagtagctttaggaaaaaataatatagaaaaaattaagtattaataatatgacaatttttaaaggaaatttgattattttttaaacaattacaaacttgtctgtcttaaaaaagtacaataaaaaaaattatttcatttttaactcgagattgtaaatactactttattatatacgtattgataaaatacacagacaagataagattggctttgttgcatgatgctcaaatatgcacaatgtccacttacgggggaaagtgcaaacaaaaaataattaagcacgctagtaataaccttttccgacatgacaatcttttgcttgcatttgcataaaattccattgacttctctaataaatttactttatagtataaagtgagtaattttaactgttaacaagagaattaacgattaatatgatgtacaatacataataaatcatatatttatatttattaaatattacttactttactttcataaattatttccttaataacaatcaatcacactagaagatatttttttttacaaaacacacactagaagagttaaatctcataaattatttccttttataatacataataagttgattttagttaagaatttaatattaaaatttagggattggtaacaagttagagataaaaaaaatagaaaaacatttaattatagataacataaaaactaaaaagcactacattgaataaaaataataatgtttgttgtacaaggaattcaaaaaatattcaacagttcgtattttgggtagtgatttcgcagaagagtattaaaagacattggtaaaagaatcttcattctaattactcaaaaaaataagtacttaaataatttgcatgcttctaatgtaataaataaataaataaaaatttactaaacattatttttttttatcagaagaataaaagataaataacgaaaaatttacaataaactgtcatactttattgaaccaactaaaaattaaaccctattggtataatcatttattttaattattttctttatccactaaaggatactaaaatatattttgtaaaataattataaaaaatggtttggggcctttggggtgcgtttgtttacctgggtggccatgataacggcaccggcagcgagatacagcgtcatgtggctggtgaggttaaagggctccgttaagtacaccccgggaggcacataaaggagcgtgcctccttctcgtggcaagtgctgaaccctatatatggcctctctgaaggccttcgtgttgagggtgcgtccatcacccacgcctccaaactccgttatggaaatgttgtcggtgcggtgccccaactccactatgttcgaacacgacaccgtttcaccctcgcccaacactaataaccaacaacatgagaaaaacaccaacaacgctaacgttgagaatccgaggagcattttcccaaatcagaaatcagattcggagaaaccgaagaatgaaggagcgtggtggatatatcactgaatcagaatgaaggaaaaatgactctaaagttataagagcacttgatttgttttgttttgtttctagtactctgtagtacttagttggtgaaagcattaaactggtagtaatggtatggttctattgtgttgtgtcctcctactgagaaaaagaatctgctgtaaagttgtgtatatgataataaatgaaatcagatggaggaccacataaaattatataatacatattgcatatttctcttccctttattaattattcttgttttgccttgcttaatgtgaaattgtgtgatgaatgataattagtactagttacagatgtctttcaaaaaaattaatagagacaaattgaaattgaaaagttaataaaacagacatggtcacatgggtatatatatatgtatgtaaaggtatttaagtaatttcatctatataagcagtacatgggtacattgatatccactcccatctttctaataaacaggtagagtaaaaaaaagttgtttaaattagtcatgagtgttaatttgactatccaattcgatttgttatgaagttaactcgtatttggggatgcgtatatggatatagattctttgattgttttgttaagcctgcaaatcttatggataatagaacctatttttctaaagtttgaatttaatgagttctgaatctggcctgttaagtttatagatctgatagactttattcgtgaattactcattactcatttaatatgattaatttgttatgttaagattgtgatctttaatttaggttattactattaatttgttatatttaaaatattggtatattgtagtataatagattttaacttaaaaaataaatcaatgtttttctaattttatacatttttcattttataaaaattattttttaaattactatttgagttcacaaattgatttgtttattcgcaagtttttgcgggtggaatacataccttgaaaaaatgtttatttacatcatagatcaagcttatatgcccatctaaaataggggctttgtaggccagatcggtctttataccaaccctaatcgtatgtatctgcaaacatttgtcacccctagtttggatggataatgttgtgatctctatccaaggagttggtgaaatatcaacagtggttgatgcacaaagaattcaagtaaatattctggccaatgatgacgatttctgacgaggtgagagacctgcaatcacttgcacaaaacactttgatgctaaagtcaaatagtgtatggagatgtgtaaaataaagttagctttttacttgtaggaatgaaatgtgacatgtgacaagcccgaatgagatctataatagttgtcttttaagtcaatgttgctaagaataactaacttagacttaagatataaagcgattttaaatattacattcataacaaatacgatagtatctgttttcatacacatttaaaaaaaatacttacacatgctctcatacccaaatggatagcaacttttggcttcattctcatatatgttggatatccatatattcataccctcacttactacccgttctttattaatattataaagccaataaattattagaaaaatactagttaagaaattactacaataaatttatgtccttccaatgtatttgtagttatttcaatgtatgaattggtatgaaagttaaaagtaacattacacaaagctatttgtatgaaatttatactattataaaatattaacattatggaagttttaatggaaaatagcttgatatgatatcttgacaaaaatttacacgcttgaaggtaaaaaggcaaacacgatttatctgtaacatttgtttaagcacgtgacagtaaaattgctcgacattacgtctgtgaaaggaaatcagggttccctgtgcttgcattaaattataattaatatatatatatatatgagattattcacataaataagatattttaattaaattaattcatataatagttaaaggataggtaagggatggttactggagtatttatacttacaatcgtgtttgttaaaaaattatacaaacatacacatcgaactcatcccgaaacatatatttattctatccatttacaaatatttttattggtacatatagggtcttggcaccctttatcatccctaataagataataacttatttcacttaattttattttgatataagttgtttaggttcttagatcattatccttaatatcaagcattaaacaaaaatgatttaacctaattgaacacaattaatctgtgatgaaaatgtatggacaagaacacctaaatttatttcattaattattatttgcaacatcaaatgtttgtttcacatatgttatacaagttgttgtttttttggaagaaagcaacttcaaagcatccatcctttttattatactattttctcctttgccctaataatgagcttaaaaaagtttttatcctaaagttgtaactggtgcccttggcggccctgcctttggtgggcccgaatttgtaattggttcccttggtggcccttccttgggtggtcctaaagttgtaattggtgctcttggtggccctgcttttgatgatcctaaaggtgtaactggtggctctggctctgaagctgtaactagtggctttggttctgaagctgtaactcgtggctttgactttgaagttgtaattggtgcccttggcggccctgcttttggtggcccaaaagttgtaattggtgcacttggcggttctgcctttggtggccctgaagttgtaattggtgcccttggtggtccttcctttggtggtcctgaagttgtaattggtgctcttggtggccctaaaggtataattggtggctctggctctaaagctgtaacgggtggctctggctctgaagctgtaactgtaagaacaaatacaaccattagaggaaaaattgctacaaacactttcttcatgttgtaaaactaatttttatctcaataaactctctaggatatacttgtattttgatgggaatgaatagaaggttgaaagaggtatcatctatatagctacaaatgtggtacattgaccaccttaatgatgtaaggtgtggttatgaaagattggcttcttattattaattttgcttggaatgtgttccttggaatcacaaaaaatgataaaatattaattgtatattgttcatttcctaatattgctttagtaactttaaattgttgtgatgacatcaaaatttatgtttgtttcatgcatttaatttatcacatttttttacaaaatatatactaaaatataaaacgttaaaaaaatattatcaatataaaattttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataaatacatgttcaaggatctaactaaaaaaaataaaaacctaattataaattatgaaatagtttaagaacctgcaattaatataaacttcaattcattcaatattttttttttcacaaaatgactcttaatttgaaaataaaatagtaaaatactagtaacgaatatattcaataattctcaattttcaaaatataacaaggtttattgctgcgcaggttgcactactccaaaatcaaaaagtagttctattgacttaattgagatattcagtgaactttaatttgagaatataaagtcaataaattattagaaaaatactagttaagaaattattacaataaatttatatccttccaatgtattgtagttatttcaatgtatgaattggtatgaaagttaaagtagcattacacaaggctatttatgtaaaatttacactgttataaaatattcacattatgaatagttttaatggaacatagcttgatatgattatcttgacaaaaatttacacacttgacgataaaaaggcaaacacgctttattcttaacatttgtttaagcacttgacaatagaattgatcgacattacgtctccgaaaggaaaccaaggtttcatgtgcttgtcattaaattttatatatatatatatatatatgtgtgtgattattcacatatatagaatattttaattgtattaatgcatataataggtaaggtagagttactagagtatttatacccactcttaaaaaattataaataaacatacattccgaacttattctgaataaacatgtatttattttacccatttatagatatttttgttggtacatataagattttgataccctttatcatccctaataatatgataacttatttcacttagttttatttgatataaattgtttaagttattagatcattatctttaatctcaaacattaaacaaaaatgatttaacctaattgaacgtaattaatctatgtgatgaaaatgtatggacaagaacacctaaatcttttcattgattattatttgcaaaatcaaatgtttgtttcacatatattagacaagttgttgtttttaggaagaaaacaacttcaaagcattcatattttttattttgtactattttctcttttgcctttattcatgagcttaaagttttcatcttgaaattgtaattggtgcccttggcggccctgcctttgatggccctgaagttgtaattggtgcccttggtggtcctgtctttggtggccctgaaattgtaattggtgcccttggcggtcctgaagttgtaattggtgctcttggtggccctaaaggtataattggtggctctggctctgaagctgtaacgggtggctctggccctgaagctataactggtggctctggctctgaagctgtaactgtaagaacaaatacaaccattagagaaaaaattgttacaaacactttcttcattttgtaaagctaatttttatctcaataaactctatagcatagacttgtattttgaagggaatgaataaaaggttgaaagaggtatcatctatatagttaaaaatgtgggacattgaccaccttagtgacttaaggtgtggttataaaagattgacttcttattattaattttacttggagtgatagagctaaaaaaatggcgaaacattaattgcatattgttcatttccccatattactttaataactttaaattgtgatgaagtcagagtttatgtttgtttcatgcatttaatcttatcccatttgtttgcacaaaatatatactaaaatataaaaaaaaaaatataaaaatttattatcaatatgaaatttaaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagatatttaatgatctttaatttgagaataaaataattgttatatttatgtctcataaatgaaaaaaatattcaagtttttaaaaatataaatcatcatctgttttgcaccaaaatatgtgagaaattaaatgcgtgataaattctaaagcaaacaaaattcaaaaccattaaaaaataaatacatgttcaaggatctaactaaaaaaaattaagaatctaattataaattatgaaatagtttaaggacctgcaaattaatataaccgtcaattttattcaatgattttttttcacacagtgactcttaatttgaaaataaaatagtaaaatactagcaatgaatatattcaataattcttaatttcaaaataaaacaagtttatgtttattgctacgcaggttgcactactccaaagtcaaaaagtagttctattgacttatatgagatattcagctttaatttgagaataaaataattgttatatttaagtttcataaatgaaaaataaaatatatttttttaaagataaattatcatttgttttgcaccaacggccgtgaaaaattaaattcccaaaacaaacataaattctaatgctatcacaattcaaaaccattaaagcaaaatacaacctatactttaccattttctatggtctatctaaaccacactccaaatattaaaaaaaataaataagaaatcaaaattcataaccactgctcacatcatcaaggttgacaaatgtaccacatctgtaattatataatgaacatctccctcaaccatttcatccatccacatcaaaacacaagtgaatcctagaaaagttcattgaaaaatagaaactatcttcacaaaatgaagaaagtgtctgtagcattcttaactctgcaagttgtattagtccttacaattatagcagcagagccagcagggaagggctacaattgtgaaaaggcaaaaagctcagtgacaccgtgcataaaatacctcactagtaaagttgataccccttcagctgcatgttgcaatggtgtcaaggaagtgaaatcatcagcaccaacaaaagatgaaaaaattgctgcatgtcagtgccttgaagaagtaacaactcacattcctaacttaaaggaagacagagccactgcacttcctaaacaatgtggtgttgatgtgggttttcccatcaccaagaacttcaattgtagcaggtaaactttattttatttttatttttttttacttttttttgttaaaatattaatctatacatattaatacccatcattattttactttcattgatatttttttacttcaattgtagcattgcttgagcaaatggcagaggaggaaatagtacattaaaaaggagggatgcttgcaagtagttttcttgtaaaaaataaaatagtttgttgaatttatgtggaacaagcatttaatgattaatgactatttccatttgttcttatccacacatcttcgtcatagagattaattgtgcttaattaaaatgaataatttgtattcaatgcttgagattaaggattcaccagcctaaataaattagttaaaaatgaaatcatgcaaaaataagttatcatctcatgatacgtatgttgggattataatagtacgtaataaaatattaaaatcttaaaaactctccctttcttatggcaacctaactaaaaaaaataatctagcgaagttaatttcaacaatgatagccataaaaaaatgggaaagcaaaataagaagacatcaaaatttaatgtggaaaactttccttgatttgagagaataaaaattacatgatctaatctaaaatatttttcacaatataaaataaacttaatcccacatttgatacttaacaacacttttgattccttaattttcggaaatgtgcaattttgatatctaacttttaactgtacaatttgggcctcgattttttcaagtaacaattaagtccctccatcaatgtgttgcccatttttattgatgtgatttgtctaaacggtgttatcaaagaatgaataagacttaaaataaattttgaatgagaccttttattactttaaattagattatatattagatatttttgttaacatatgacctttttattttatcaaaaaaactaatagcgaaaaaaagtctataaaaagtttgatgcattgcattttaattaaactagtgtaataagttgtatcatacacaaatataaaatttatgatttataattttttatattatatggtttttaatatacatatctattattttttaatttataaaaaatgtaaacatgtagccaaagtatgtgtgtgaatattaatgtaagattagtgtattagaaataaaaagtctgttataaatattttttttatctattattttatattttaatgtttgctcgtttttaaaagtaggtgttgacaatcaccaaacactgaattactctcaataaacacttaattatcgaattagagtcttaaaatgcaacaactatgttaaacatctatagggagattttttttgttgtctataatgattatgcgaatacgattgtttcccattggaacagaccaaacttggcaagtctttgggttcgagaccaaaaccatagtatccaatgagtatctatctacgaaaaagcgtagaaacgttccgtatttttcttcgtcgttatcgtttcgtataatagcacaacacataccatgccatggatcaattattaccagtcactgtgcattattgttgttgagtaacatagccattagccatatctctctcccatcacattctccgcttcttccactgaaatcccacatgaatgtcactctcacttcactcgcctctctcccccaatccctctaattccactgttcagctccgctacggtgagatctgggaagctagggtttgaacttcaggctcccaattagggttggattcgagcgtgttatgaaaaccaggagattaagggtgttgcattggaagtggctttggatgatggttttctgtgggtagcttcaattttcggggtggggtggggggtggggtgggttatgaaataggatcatttctgattcaaaggggcatgcaaaatttgcgacctttataacaataataatgcttttattcgacttggggtgcttcagtttttactagtttggaacttcacctattgttatagctccaagcatgaagctctcttcttctggatttaacccacctgctgaagaagaaggtagcagtggaagtagcttctttgattctttcattttgtgcaaattgctttgtattttgctgcttgccctgctcccactttttgaaagtttcttatctcttgtcttttccttggtttgttggtgtagtggtgttttttgtgttggtagttctttttgtctttgcatgggtttggaggtaggggttaaggatactctagtagtactttaacttgtaggggttggtttggcattcttatatgacatggagtgaggttgaacaagttgccatagtttgtttttgtttgtttataatatgtatttatgtcagggtcaacttcttagtgtcatgtggatttgatttgtgtttgatttgtttcaacttcttatgtgacaaggttgtattgtgtgttactatttatgtgtggttattctgtttgcctgtttgtttttgtgattggagttcggattgtggtatgtttttttttttattggtaaaatatgcagtggatttaatgagtttattactgatatgccacttgtagactgggctaaggcgtggtgcccttttgacttgtgtgaaatgatttacttcatgtttattcatattagcctgtgattgtgtaggggagaaaaaatgtttgaattctgaactttggcatgcttgtgctggccctctggtttctctgcctctggttggaagtcgtgtagtgtactttccccaaggtcatagtgagcaggtaagtaatgcttcttgtatcctataagttggatttattgcactatgcttgaatttttcgcatttcatggatatttgttgaagttgctatgctcatgaaaagtacataaagtcgtatagaaaattagaagctcatttagtatatctatatgatcacggtgagcaggacagttgtaatattttgatctgtctgccgaagttagtggagtagacttcaacttattgtttcttgtatgtgtatggtgaaatcagtcatgcttgggctagtgcaagctcatagttttaagataagattgatttggtatttgaactgataggactgggatttacaattgtctgcagtactgtgaaagtatggagatgtaagctgtaagttacatgttagcagacttcatggattagtgtttaagttgttgtgcctggagggaaggaggatgggctaattaagtgaagagaaaataaaatatgctccaataaacgtttgatttaggctttctgttgttgttgctaacattctagctcataagtgaagtccctagtaacagatatgacattgcttcattcttgaaatgagcagcattttgttaaattttaaatagaaattgtggcattaaggtttctgttctagaatagtctgagctttgatcagtctgattatcacggtataaatcttatctataattactatgctaaaaatgagtgactgacagatagagaactctttattgcatcattatggttattttcagtttcaattttttccccggggcaggggagggggttcaagccaaatggttctaatctattgttgttgcttttgaaatttccaaataactgattgcttttcatatatttcatttatatttggttcttcagttatttgatagatgttgatgtttatgttacaggttgctgcatcaaccaacagggaagtagatgcacatattcctaattaccctaacttgccaccacaacttatctgtcagcttcacaatgtgacaatgcatgtaagaataaaattaatagttgagaatttcagaaaacatttttatgtgcttacactctgaaccttttaagcatgcaccttgcaggcagatgctgaaacagatgaagtatatgctcaaatgactctgcaacctctaagtccagtacttttctcttatttgctaccttttcctattttttattttttttattttttattttttttatagcatgtcttgacattatttattttgtagcaagagcaaaaggaggtgtatctgctgcctgcagagttgggtactcccagcaagcaaccaaccaactacttctgcaaaacattaactgcaagtgataccagcactcatggaggattttctgttcctcgaagagcagctgaaaaagtcttccctcctcttgtaagtcatttatctgttatatttggttcacagtaattagtttgtcagctcttgatctgactgatgtgtttctttaatttgtttctcaggattactcacagcagcctcctgctcaagaactaattgccagagatcttcatgataatgaatggaaattcaggcatatatttcgtggttagttttttttttttttttaatttttggtataaaattatttgtggtccttgcatctgcttctttatgtccagtttatgctgtcacactcaatttcttgtaaagaaaagcacatctgatgatattctataaacttaaatctgggatcttcctttttatcattcaaaacattaaaattggagtagcatttgaagcaggacatagttttctaaggagtaatttaattgcgtattatatgactatagtagatgtacatgtactattttacttctgtcttattgcagactcatttcatccttatttgattcgctgcttggcttactttgtttggccattttcttttcttgtgttaaactttagtcaaccttggtcattttctttactcatactacatttaaaatagcattactgttgtaatttttaatttttagtcaaccttggccaatctaatttttgttttgcatgaacagtatgagagctgtgttaaggatcattatattgttgagtgtatagtcctttaatcatatacatcttatctttggctcttcctttcctcctgaagatccttttccatatcaagtttgataaattgtctatagtgaaaccaaggaatgattagcaagcaacagtcgtgatatgtggtgtcatgaaaaagctgcttaaattgttacttaaatgttttcacttctaactgcttcatattttcactttcaggtcagcccaaaaggcatcttcttactacagggtggagtgtctttgtcagtgcgaagaggcttgttgctggtgattcagtccttttcatctggtacatgtaatttttgatatttccattaaattgacctattggagattcaactccttttccctccctctatcttcgaacacagttttagttatagatatatttattatggatatatttaagcagaaagaaaattacaagagggctttagactagaaaacattatttcaaaataatgtatctgtgggagctttttgacctgataaatatgttttagcttgttaccctgcccgtatagaaatatcgtcggtaattgcatctatataggccacgggtgcatgattgaaatctattcaaatgaactataagatattattgtaattcttcttcttctttttattaggaatgaaaaaaaccagttactcttgggcatacggcgggcgaatcgtccgcagactatcatgccatcatcggttctgtcaagtgatagcatgcacattggtcttcttgctgctgcagctcatgcagctgccacaaacagccgctttactatattctataatcctaggtgtgtaactttaatgctaatgctaatgatgagaattatcaccctacaaatcacactgaacatgctcccccccctctaattttatagggcaagcccatctgaatttgtcattcctttggccaagtacgttaaagctgtgtatcatacacgagtttctgttggcatgcgatttaggatgctctttgagacagaagaatcaagtgttcgtcggtaggtatttattgtcttaaattttcctttctcttgtcactattttgggccttgctcgaagaagaaactcaaggaggacaaaaaattcttctcccatgtgaatcttagtgtttactttatacttttgtctgatgacttagagagacagttgatttggttaaattacttcttaggtccccgtactttttgaaaaaattcaaaatggtctttgatggtttgaaattttaaagtttcctttttgtaaatagctccctatgactctctaatggtagggtggattcgaggaatcttaattttttttttttttggaaactataggaatccaacccagttgctaattcaaactatagggataactgagttctctctcaaaaaaaagtataagagacccatgaagtaatttaacttttttttttttggttacaaatttaacctttaattttactttccaaatttatttatgttcctctttaaatgtggtttatcaatgaatgtgtggtgataaccacatagtactttgggttgggtgtgcagtgttctgtgtcgtatcaatgaagaaacaaatatgctgctattcacagaacactgcaattcccaatcagcaatgcgggtaactgcacatgattccatcccaactttaacagtgaaagtattagttggacccctttaaatctttatctgtgtgtgactatgacttcaacagttgtgtcagtagcaagtcgatcttgtttccctttagctttcctcaattttggttcctgccattttatgttactgatttgttggtttctaaccattattattgtattaataattttctgtatgccatttaataccactctctgctgtgcactccttttcatgactgttgatgcattacttatgtgcttccaaaagataaaaagccaaaatttttgtgactgattagccatgacaatatatgcttgtatccttccaaaagataaaagctttggatgtttagccacgacaatatttgcttgtcctttagaacagtggtctgttctaagtttttttttttttttaaacatttgaacctatactcactgtaacatgttcttgtccagatacatgggtaccataactggtattagtgatttagatccagtccgctggccaaattcacactggcgttctgtgaaggtttgttatgactgtttgattcatatagcaactatatggcattgtcatgatagaatttagcaatattatagaaatatcagagattgtgtttacagataaatgagatgatgtataatttggttttttaacttttgtctatgggtgtaggttggctgggatgagtccactgcaggggagaggcagccaagagtttccttgtgggagattgaacctttgacaacattcccaatgtatccatctccattccccttaaggttgaggcgcccttggccatcgggcttaccttctttatatggtatgggtggttttgttaagtgtcatggcattctatgggatctgtgacaatatgcttgttttactttttgtcgtgaagtacatgacatcttcaccttaatatatttcttccttccttttgtgtaagtcaggtctcaaggatggagacatgggcattggttctccattcatgtggctccaaggtgggcttggggatcaaggaatgcaatctttaaacttccaggggcttggtgttacaccatggatgcaacctagacttgatgcttctataccaggtctccaaccagagttataccaagcaatgacttcaaatgttcccagtgctcatgcttctgaggtacagaggcaagtattaccacaggctcagcctcaaaacacccttctacacaattttcaagaaaaccaggtgcctgctccgtcacaacttctgcaacaacagttgcatcgttaccacccttatagtgatcagcggcaacagcagcagcaacttaaaaacttgcctgttcagcagttaccaaatgtcatctctcctttgtccaattttgcatcaggtacccagtctcaatctcctcccatgcaagccctagcttcacattgccagcagcagagctttcctgaacctatgaggaatcatatttctggttctgatgtttcccctatccagagtctactagggtcattctcccaggatggaacatcccagttacttaacttgagtggatccaattccgttatgtcttctgcagccatgctacccaagcaaataaccgctgaacctcctcagcttccatctgctgcttctcagtgcgtattgcctcaggtggaaaacttgggaacatcacaatcaaatgtgtctgaacttgctgctttgcctccatttcctggaagagaacattctgcataccatgctgctgctgatcctcagagcaatcttttatttgggattaacattgacccctcttctcttatgctgcaaaatggcatgtcaaacctgagaaatataggcaatgtgaacgattcattatcgttgccattttctgcttcaaattgtggtggtgcttcagtcactgatttccccttaagttcaaacatgtcaacttcgagttgtgtggatgaatcaggtttcttgcagtcttctgaaaatgtagaccaagcaaatacaccaactggaacctttgttaaggtaatagctaatgccgtttgtttataggtagtatgcctttatttatatattttatgcggagccacttttgaatatcatttaccaaaattaagcaacagtttattagttaaagaatgggttcaaggtacaagttaaatatatttatataatatatttatcttcaatgttgaattggttctgttgtacggggatatttgggaccctatttttatataaagagcatattgcagctactttttatttttgtttcctcttttttgtaggactactattttctccaattagtaagtggatgttgtctactgtctaggactattactattattctaattttatatggtgatggatgtggtgtaattttgacaggttcacaaatcagggtcctttggcaggtcactggacatttccaagttcagcagctatgatgagctcattagtgagcttgctcgcatgttcagccttgaaggccaactagaagaccctaagactcagagatcaggctggcagcttgtatttgttgaccgggagaatgatgttcttcttcttggtgatgatccttggcagtaagttgccatatgccagctgttatttacgttccaagttataatatactatcttgggatttgactacatccttcattgttgctaatgtcattgacgctataggaatagtcagtaatgtttcttacatatttgataatttgaacatgtcgacatttcacaaattttttattttatgggtctgaataattatttgtaccatttttcttgttccttctattaagtttttgctcactaactttgagtataggttcattgctttgagattactgaaatcatagtccacgcagaagagtatctaattacttgcgcatgtcatcccaagtagtaaaaggctagaagaacgatgcttgactaaaaaatgaatatatagccaagaagcacatcattttagactttcctgattctgcacagaaatatttacatttgataattttgcagggagtttgtgaacaatgtgtggtacataaaaatactatctccactagaagtgcaacaaatgggcaaaggtcttagtccttctacttctgccccaggtaacaaactttctactcctgccaactcttgtgataattatgtgagtcaacaagagttgagaagttcgagaaatggcatggcatcaatgggatcttttcactactaggacactctcccatgtaaggaatattagttgaaaaattatggtggcagaattttatgttacaagttttcttatgtatggattggcccagcattcttatacacattaatggttgacatgtgattttgcaaggtctaaatagatcaacagcaaatgactgtatattataataggtgaccttgtttctgtaatggttagttgcttatagcaattattaattattactgtatctcttatttagttttgcaatcgaaaatttgggagcttcgttgttgttccattttcttttatacgcacacaccaattttccatcatatttgacaaacggtccctactgacaacttttcgtgaaattgagtttcaaaatcgacaaataaaatgtttctgatgaaaaataatttcatttaagcaatatatattgtaataaagaatatttcaaatggtttttttggagttgtcaaatataaagtttctgcagttcaaggcttcaagcataggttaatactttaaaaaagttaatttaacttgcgtatagtttttcgtttaaaaacaacaaaaaaacttatgaaaatactagtatgaaagaagtttttttccccctcttttaaaggtgcttaaaaagttttttcaattttctttcagtcgaaaaaaaggtttattcaaatagtgctaaattatttttacaacctctattcattcactttttcttttgaagttaaatatttgattcgctaaactgaacaacataattataaatgttccatgttaaaaatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaacggtgccaatggcttcctctttgaagtttcaagtttggacgctcgtagtctgcgtttaaacgtggaacctaacaaacatcgcctccctcctctcatcgtaacaaacaaatgcggttggactttggacatgtgtgtttcaattttcattgacaacaaggagggtgcactgtagcatctgtttcttcgtttattgcgacccacgtcgcggtggctccattggggttagtttctctcaccttcatgttgaaaacattaaaatcctcaatccatgtcaatagaaccaagctagtttgcttcaaaatcccttctttcccactttccaccactgccactggtaccaatttcaaagataacaatgaacctgagagtagtagtgacacagagacagagtgggagagattgctcaaaccctttgacctcaaacagcttagaagatcactcaccccaattagcccattccagctttgtaaattgttggagctccctcttgacattcccacttccatggaactgtttcaaagggctggtgcccaaaaggggtattgtcacacctttgatgcatactatctcttaattgataagcttggggctgttggggacttcaaaattatcgagaagttgttgaagcaaatgaaagatgaaggagttgtttttaaagaatcactctttatattgattatgaagtattatgggaaggctggattgcctggccaagcaactaggcttttgttggacatgtggggtgtttattcctgtgatcccacatttaagtcctacaatgttgtgttggatattctagttgacggagattgccccagggtggcacctaatgttttctatgacatgttgagtagaggtgtttctccaactgtgtacacgtttggggtggtcatgaaagccttgtgtatggttaatgaggttgattcggcttgctcacttctcaaggacatggtgaagcacgggtgtgttccgaattcggtcatttaccagaacctgatccatgctctttgtgaaaacaacagagtgagtgaagcgattcggcttttggaggacatgtttctgatgtgctgtgagcctgatgttcagacattcaatgatgtcatccatggactctgcagggctggtcggattcacgaggcagcaaagttgcttgatcgaatgctacttcgaggtttcagcactgatgctttaacgtatggatatttaatgcatgggttgtgcagaatggggcaagttgatgaagcaagggcgttgctgaacaaaattcccaaccccaatactgtgctctataatacattaattagtggttatgttgctagtggaaggtttgaagaagccaaggatcttctgtacaataacatggtaattgcaggttacgagcctgatgcctacacgtttaacataatgatggatggactagtcaagaaagggcatttggtctctgctcttgaattcttctatgatatggtagcgaaaggctttgagccaaatgtgatcacatacacaatattgataaatggtttctgcaagcaaggacgattagaggaagctgctgatattgtgaatagcatgtcagcaaagggtatgagtctgaatacagtagggtacaattgcttgatttgtgcactgtgcaaggacgggaagattgaagaagctttacagatgtttggtgaaatgtcaagcaaaggatgtaaacctgacatttatacatttaattctttaataaatggactttgcaagaatgataagatggaagaggccttgagtttatatcatgacatgttcttggagggtgttattgccaacactgtaacatacaacacgttggttcatgcatttcttatgagagattcagttcaacaagcatttaagcttgttgatgaaatgatatttagagggtgtcctctcgacaatattacatataatggccttatcaaagctctctgtaaaactggggcagttgaaaaaggattgggattgtttgaagaaatgcttgggaaaggggtttttcctactattgtctcttgcaatatactgatcagtggcttgtgtagaattgggaaagtaaatgacgctctaaaatttcttcgggatatgattcatcgtggtttgactccagatatagtcacttataacagcctgatcaatggtctttgcaagatgggtcatgttcaagaggcagcaaacctttttaacaggttacagagtgaaggaattcgtcctgatgctatttcatataacacactgatcagtaggcactgtcatgagggtatgtttaatgatgcgtgcctgcttttatataaaggcatagataatgggttcattcctaatgaagtcacttggttgatactgataaattatcttgtgaaaaaaataccacggggagcaagaatttctaaggattttatggtggaatttggagtttcttttccttgaagccaacttattctttccagtcttgatcttatttgatttgtctgttggcattctgattatgagctaatgttggctaagaattttggtccatttgctatgctcatgggaaattgggactccaacattgtgaattgtttttaagatttgtggattgttattgctggttggacttggagtttacacaagtgcagaatggggaaagactattttgagttatatcatcaaactggtcaaagttttctgtagttgaagcataaatatgtatatatccgtagagagaaagataggtgtggctggttccactgctcgttaagaggtaaccaactattgccttgccatgttgaactgtctcccctcagattgattgatatgatttttaaaaaaaaaaaaaaactatgacatgtttgttgtttgtcctcatctccttctctggttacttggttggcttgatatgattgtgaaactgagcttttagacataatggtggctttggttttagttttgttttttttctgtatttgtagcttgtgcttatgttgcagttggtttgagctttggtgttttttgttgtaggaacaattcctggttggggtggataagaaatcacagggttggtgattggttgttcccctgaaatggcttgaattataacggccaagggaactggtgtgatagaaggaactgtcagatgaactggtgggggaaattgacagaattggcggaaggaactgtgataatggttggtgtatctggaggtttcatgactggtgtaggtgggcttgaatttgcaaggaaaactgtggtaggtgagttgtttggagatcttgctttgtggaagaatggggcaccaaccgatgatgaggagagggtgttactagaaaataggaaatttgagtaaaacagagtcaaagacagcattccacaatgcagaacatggacgtcgttgtaatataccataccactatatcaataattagtttgattttactccgatataaaggtaagcacactgacataaaagaaagagaagggttgctgtgaactcagtgatttgtgagctcttctgtgtctccttatctcttctgtctgtcagtatctctttaaaaaaaaactcgttgcttttatctttacacacaagtatgtcatgtttaacaaagaaattttacccttactcagagtcagttatgatttgtttagtcgttaatgatgatatggcattaatttaattgctattttattacattttgtggcgcatcacaaagatccaacataatccccaaatcaacaaccctttctcctttcttctttgccactcccaatttctctatgtctacactgaaaatgaactcaagttgatgctcctccttaattctatttttttcctgctttgttgtcctctttaaccaacgttctatccttttcctgaacctgacaaaggctctgcagttgtttttttttaataactcttcccaaggtcaaagaaaaaacgaatcaaaatattttattgtttaggttatggcaaattgataatatatatgtactacacaaacaacaaaatcttttgatttattttttctttgaccttcagaagagttattcaaaataagcgatgatagagttctcgtgaagttcagggaagggaaagaatgtggttgaagaagacaaaaagcagaaaaagaaattagaactaaggaggagttgcaaattgagtccatgctcaatgtaagcattgtgaaattgggagtgatagagaaaataaggttgttgatttgaggaatttttatttatttatttgggaattgtgtataatctttgtgtttttattggggaaaaaatgtgatcaaggggaaagatcactaaaagtgtctagtcaaagtcaagtgtttaagcaaaaatcagtcactaattaagccaatgaatacttcgtatttgtaatatggtgacccaaaataatcattgataaacgatctagcatgtggatcaattgatatatagttgttctaccttaattatggtcttaagtttgagtttgtcttaaatacttgaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtatattaatagttataactttttcaaatcttaattaatataatcaatacaaatatgaaataaccaatttaatatatttttttatttatgcacaacaatttaattaaataaatgttagaagatctatctaatatgttaattaatgaatgttatgacaataaatttattttaaaaatttcaatggtactttatttgaccgaaaaagaggcttatggcattccactcaataataaaatcaatataagatggtaaatactcaaaattttttgggactcgatgaaacttaaacgcccttgcaaaagcgacttggttgactatctcttgataaaacaaaaaccataacgttttgacagaatctaagtaaggttatacaaattgtcacaatagaaacaaatttaagattgttatgagatagaacatcaactaattgcttgtaatctaattcaatattcacatttagtgacttcataaaatcaatccacttaagaataagtagaagtgcagtagcctatgaaaaaatggtccttatctctaaacccatgattattccaaacatttattttatcagcattttcaaattgtcatctaaaatcttcattgacgatagcctgtgaaacatgaatgctacactaaattaaactttataaatttgatttgacttgcaatagatttaatgacttctaaacaatcaattagataagttttataaaaaaaaatccggattaaataagtttttatccattttcaatccactcaaattaatgaatattttttctattttttttaatttctttcaatttaatatagtattttgactgttattgttatattaactcttacaaagcttaattaatataatcaatacaaatatcgaacggtcaatataatctcatcatcataaattatagtgattttatttactcagtcacaacaatttaattaaataaatcctaaaagacatatctagcatgttaattaactaatattatgataaaaaacacactaaatatttttaggataaaggatcaaactataaaaaaataaaggactaaatatgttatttttttttaaaaattgtaacccaaaaatcacactatggtgagggaattcaacccttcgtttcgaattcaacactgtaagtggcgctgccttctgttctgttgctatggggtttagggtttactccgttacggtcgtcactgactcttcttccatctcgtgaagcgaatctgttactcattcactgcattgcgaataacatggcattgtcaacgaatcgagatcagactcccaaatctgactccacaaacccctgctgtgaactcgtaaaaaacctctctctctttcactcacttccattttctttttccacttcactttttgattttaatcattaatgtgttctctttctcttatttctcatacgcagtggaagaagaaatacttgaagactcaagaatcgcggaatgctctgcgacaagccgtcaaggttcttgaacaaaaaattaacgaaatccagtcccgatacaacaaaggtaactaactctttattctttttttttttttttttaaagttttggtgtattatataatgaatatttggttttgttcgcagtatgcgtatgcaattggtttagttgagtgaataatgaatatgctagtaatgtgattgatttgatgttattctctgcagtatgtggggtcaaagtggaaagagaggaaaaattgggagaatttgttgctgctagggcacctttagagagtgaaacttgcagcttggagtctcagattggtactcccataacacagctgggacgtggcggtggtggaaatgagaatgggaccttacaagctgattgggaaaaggaaattggtagattgaaggagcttatagaagtggagaagggaagggctgattctgagaggaagaaggctgctgaagcttgcaagttactagagaatgagaagaataaggttgttgaaaaggaaaaggaagtcggtggattgaagaggcttatagaagtcgagaagggaagggctgattctgagaggaagaaggctgctgaagcttgcaagttactagagaaagagaagaataaggttgttgaaaaggaaaaggaaattggtggattgaagaggcttatagaggcagagaagagaagggctgattctgagagcaagaaagctgctgaagcttgcaagatggtaggggatgagaagaataaggctgcggaaaaggagaaggaaatgagtagattgaaggagcttatagaggtggagaagagaaaggatgattctgaggggaaggaagacactgatgtttgcaagttacttggagaagagaagaaaaaggttgctgaaaaggaaaaggaaattggtagattgaaggggcttatagaggagaggaaaagaagggttgattctgagaggaagaaagctgctgaagcttgcaagtcactagaagaagagaagaaaaaggctgctgtaaagggggagattgccagaattgaagcggagaaggcagtgaagtatagttttcaaattgatcaattggagaaacaggtaaacgaagcaaaaacaaaattggcgtatgagatttctacgtatagagaggcaaccaaaaagtttgaagctgaaaagcgtaaactattagcagagaaaataaatgctgagtcagggatggcaaaagcaaatgaaaggttagaggttgaaaaacaaaaggtcgatgaggaaaaaaggcgtgcagatgcagagatggttaaattaaaggagcagaaggcacttgctgaggataactggaacaagttcatgaaagaaaaatgtcttgctgatcagatgtctcagcagttagaagaggataagcagatgattgaggatttgaaacggaagatccatgaactctcgtccttgactaaacctgttgaaatggctgctgacagcaaggtcaatgctgaaagtacagaagtgaagcttttaaaaaacaaacttaagcttgaaaagctaagagcaaaacataccaggcaaaaatataagttagaagcaagtcgttacggtattttacgtcacgatttaggtcgtctaaagatggatttcattcaatttctacaacgccttgatatactggatgcatccttttcaccgcatggccaaacaaaggttggtttcactgataaattgtttgtagtcatataatgtttgagtatttttgtcattttttatctcctctccctgttgaaatcatgcacacttttgaagccaatgatctcattctggcttactctcatatgcagattaaaagtgagactacttatgttatggacaagtggttatgaacttgttggttggttgtcccctaaattattgctatctttgggtttatcatcatattagctgtagcactaacagtttatttaaccttgggaaatgggaattttcaggatcccctgaaagcaatacataaattatttgggtggttttattatatatcagcactaagtaattgtttagtagttatatatagtacttggttttagttttatctttttgggggtgggggagaggaaggaattaaagatttttttgtttgcgagaggccttggttttaggtcagagttcatataattaaatatatttttcaatttattttttttgtttctctttttattgtatgttattcttgtgtatgcacaacttaactatttttttttttatctttgttgaatgattggtttgcagtttgagaatacactagatatgcagaattcaaatgtcatgagacaaatttgcaatctaaatttatctgagacacgtcgccagtttgagaatgagcttctggaaccctgctgcacaacaattgaggcaagtgatccattgagggaaaacatgaagaacactcaactcctcactccaggtagaaattactctgaaaaatctatcacaggtattggttctaaattggagcctcttgttagaggatctgacagaacaaagttacagagttctgcagtaaattccagtacagaatctttttctgatggacagttgatgggctcacaggatgcaaccattttcccagttactgcatcagcaaaattgactcaggacttcaagccatctgacaaatctgttgatgtgcaccacaggaagaggaaaagaacgcaggacacagttgaatataatgcaaatttatcttctgagaaactctctgatttgcatggtttgatgcatagaaaagttgtcaaatgcttagacggagaaaaagaggtgcttcataatctgaataatttacaggaagagaataaaagggcccacaaaaagagaaagaaatatcgtagggaaaaagtggacatgattcctttggttaacagggatgagcaaaagggcacagaagaggccgacactgaggtctatgatgatgcaaatgtctgtggacacacttcctgccctgctccacatactttagaaacctctcaagcatatgggaataggatatgtgatgctgtgaataatttcaattcgatagttaattttgatactgtgcctgatggaaattatatgaaattattagaattagaagatgctacaagtgaggaatgctatagaaaagcaatggattttcccatttctccatctcttcctgaaattgaatttcgtgaaacatttgaagagggtaatttgacgaatatctctctagaggaagcactccaagatgacatgttgagctcaagaacagacctgtttacttcaccttaccttgatgtaattaatgttgaaatcaattctaacgaacaaaaatgtgatgattatggagtttcttgtaatttacatatgcactctacagaaaagtcaaggactgctttttcggtggaggatggaattggatctttaaacaatcaacttcctgaattttgtgttgtcttttcaagtattgaggacaatagtatcatatctacgatacttgttgctacaaaaaattgtatagctcggtgcaatttggctactcaaacaggctggggggttagtaacattctgactgtacttaaaatggaagaaaagctctcacagaagtaagtgtctcacattttgtgatagtatagggtcaatgctgttgaacaccctttatagtttttgtttcaatattttgcttttcttgtaataacaaacaaatcagttcatgataatatttaactgtggacaaatggtggtgttgatattaattttattattttgtttcatctaatttctttcagggagaaggtttcggtgctgttaacacttatgctgttcaactttgccatgactgcatcaaagacatttggaaaactttgggatgggaatttattccactgcttgcaatcttattctgaacatatttgcacaggtttggtaatttgtttcataatcaacttccattttcggaacattaaaagaatgtttttaattatataataatattaatatcatgttatttaaatttgattttaatttgacaaaatttcacatctttttccccagttatgtctgttgcagagacaagaatcctgtttgtagagaattattctttgcgcgagctgcttagcctcattgaagattttcttattgagggaaaagtaatagtaaacagtagagtagatgctgaaactttgtcttgtgatttgagagccaatgattttctggattgtgttaatgaagtatcatccgatgtagcttcaagtgaacaattggcagcagcaagtattatattagcatcagtatgtgctgcaactgatcatgttggatttatttgtgatgcttcatatcatattcttcggtcatgcaagtgggattctctgatcgtgctgactattctccatatttttgcttatctgggtggagagaagttttttaacatggataattttggattaatggtgactgttttgaaatctctaattatgtttcttgaggatgagagcccatctgttgcatctgcttgtcttccttcaataaatcagctgcatgctgagttgtgtatgaatgttaaatgcccattctcggaaggtgctgaatccattgatgcagttgcatgtttgctcttggaagagataaagcgaataaatttgtcagattccagattaatgtcagacaattataatgctggacaatggtataatcaggatgcagttcaatgtgccattagcaagaactgtgatgtgccctgtttgaaaaaaggctcgatttctgctactcaaccagatgcccttatgaatgtcaacttttgtcgcctgaatgacgtcctgtcattggtggaactggttgcaaacaaaacggtattattctcattatttcaagttaatattgaccctgtcctataatttctttttatcaagttctaaaattaaagactagttctcctaaaataagtgacattatctttttttagaattgatgccatactgaaattaatagaattttacaatatgaaattggccatggtatagttcttgaaagtgatttcactcgtggtattcaccatcatttactgaaataagtgatttgttgccaaggcccaagtttttttatggttgagttatattgttctcaacttctcatactcgtggaataacttgtcactttattttgttgatgtcatcataatcaaacctgattacatgtttccttttcctaatacagagctggcactgggctgatatgaaacttgttcctcagcttctgaatatactcgactcatgtgcagaggagaactttgctgttcgtataattgttcttcttggtcaacttgggaggtaaattgatcactgcttcttggatattgctagtatcatgaccacattcactgcatatgtttgtaactttgtatcgatagaggatatatgtatgcttatcaagattaaaaatcacttactactaagatgagtatttagtcatcttaaggaaataatgatttttaattttttattgaattctaaatcccaattgctgtgctagtgtggtagaagccttaggctagggttaaaaaaataccaaaatgagtgatttccctggatatcgagagaataggactatccccactctctaagagtcttatcctttttcaaatgataagataatttctctctcaactcccctctttatttattggcaatatgccttatttcttctactgtctcagcctgcccaaataacataactaactccctcactaagggacacctaactactaagggacacctaagataatttatgtcacaacacattctgcttttttggtagcacctacgctcagaatctttgtatggtgatagtttcatttttctcattaacttttactgtacagctgtttctttgttgatcacatatctgtgaaaaagccatggtgccatggacacatgcagacttttaaatattatttgatttaacaaagaaagttgctttcacatatttttgcttgtgttataacaataacaaagtcataaatgacgttataaatttcaggactggagtagatgttggtggatatgaagataaaggagttggaaacctgagatgttatttgtatacttatttttgccgaacctcttccatgaaagcaggtctttctcttcaagttgccgcggccactgctctgtttggccttcttcctcttgattttgaaaccctttttcatactaaaatccatctttcagcatattctaaatctgtttctgacaatgctgaaactttgagaaagtggttctctgggctgggtaaagatcaacagaaattgctatctgatttatttagtaagtaattttttttgttactttcacatgaattaaaataggataccggagccagttgatttaattggcaacgctcttggagaagttttgtagattgagaatttttttaaaaaaaattagatggcgttgattcaatctttttgagagccttcaacatggcttgtaatcttgtatgctgttgtcgtgcttctgaaatttgtacattctttctttttttggctgtaaatttgtaaatttcttgttattatattttatagtgaaacttgttatccacctgcaagcgttattgtgatatcccccttcatggttttagacattcatcgtaggccattactacaggagaccacagtcataggtggggtccattttgaaccatcaatcttgaccattagattaatcttagtattgtaagtcatcccacaccaaatcccccacccagcaaccgctatttgctgtctccaacatcgcccatgatttattttgccacctggtgagatagagagacagagagagtgagagaacaacttctccattctcaatttaatggtcaggtcaatctgattaatggcatccttttgttagcatgttgtatcctttccagatttgaattacttccaatcatccctccaaatcgaccaccgtgcatcgctgaaattgtcccttttaaaaaagctgtggaggtcgattgacccaacgagacacaatgaattagatccaatttaacacatttttttgttggtttgcttcaaagagagatactagatttgtagatctgtcccaactaggcttgataaactttgcttttcttttagaaaattataacaataacaataacaagcattgtgcggtgcattttggggacacttaaaaaagcttggtccttttaagattgaaggcaccaaggctacattatgaacatgcaaaaactgttcatgggtgaagggggtcagtgagtgagtgtagtggcgagaaaaaaaatgtagtcgtcagaaatcgtttttggcagtggcgaattgtggttggtgtgagatggtctgcaatactaaatttaatctaatggtcaggattcatggtccataatgaacctcctatcaagtggtccaccctaaaattcaccttcatcctaatataatgaagcattcaaaattagaatacaagatcaaatagtcagttcaacaacgacaattggaaggaatactgaaacacatggatgatggcgatggtcattataatagtatgatttgaatccatctccaattttaaacattatttcttaggcagaagtagatttacgttcaagtcttgatttgagattaagcttaattttttgtaatatgcacgacttgataattattttaccttaccaagaacttcctaatatagaatgtagatattctattcaaataattatatatttgactagggatcaatttactaaacgagtaagttttctctatttcttatgaaatgcgaatcatgaatcatgtgataatatcacggtgatcgtgcatgtaacatcttagaaagtgaatattcatatacatgtaatcctatggtgaagatttacttatattttgaaaactgtattgtacattaattcaagttgactgatgaaatattaaatattttttaaattatataaaattttatctctctttgaactttttcgaaataacttaaatattgtataatgatttttttatatattatcattcaaccatgaatgaattattatatatgctcaatttgttaattttctatgataattattttaaaagttatatatagattttttttattggttaatagtataaaattttaactctcacaaaacaccatgcacgaaaattaaactcatgaaaaatataaatatatttgttattttatctgaaataaacgagggaaaatatctcttatttgagaaaaaaaataataatatttttgttactactatgtcataagttaatatcttggaagtttaaataatattaacttgttaaaataattcaatttttttattctgtaatatgtattagccagtgttaacacaattaatttgtttttggtaataacaatgcttacacatgcacaagcaaagactcagctcaggtaacattcatacattctattaacatgttggagtcacaagcattattataatacacccaatttttcctattaaatgaaaaagacaagaccctataacccacatggagaaaatgatgatggttgattgtcgaccaaaggtgacaattagtgaaaacaatgatgatatgattgctaaaagagaaataccaataaaatgtttacacattatttattattaactgaacattctgtaaattgtaaagagtttaataaatatattgttaagttgaaagtttttgcagcattgttgcttgcacttcttgtgaagcaattctgaccttatttatatactatcaatcaataaaaaaatatcctgtgtttaatacagatgatgatattaaaacttttagataatgatttttgattagacaataatgtaaaaaacttttatattttactaaaaaaaagttttttttttttttaaatgaatgatgctgttattcacttttctcatttcttaacagtcggtggaagacttttagtttagctgcttcacactaccgaaggtcattccttccccactttgaacagtaaacatttttactattttttgcggttcgcatatttttcaagtgacagcctactaatcattcaaaggtgtaaaaaattgaatttttattttcagcaacaactttttttttttttttgtacaaaatatatagataccatatgtgatatgtctataataaattaataactgaaggctgataaaaaagaaggttaataactgaaggtagttttatctacttgtctctatgtcaagaagcacgtgaaaacaactgaaaggtaccaacaaaacatgttggaaggttagctacataatcttcggtggagcaaatattccacttgtccacatgcatgcatatataattggttatttggaatgcctcattccatgcactgaaactagttgtgacacttgtattgcagtgcacataataaccatgggctctttggagcaccaacgtttgctacccaggcttgactcacactcacacattcaaaacttgtcatcagatgccattgaagaattcttggaacataggcctattgcattgagatggtggtcaaagcttgttgtgtgggagtcaaggcttctctggctcctctctggggcttctattgttgtgtccattttcaattatatgctaagttttgtgaccttgatgttcactggacatttggggtctctagagcttgctggagcatccgttgccagtgttggtattcagggtctagcttatggtattatggtatgcctctttatctgctgcgccacttaacacactcttttaaatacattttctattagataaaacttaaaatgcagttccataagtgctttaagtgttgttctttttcttttagataaaatttaatgcagttccataagtattgttgttctctaatcagattaaagtttcacttaattaatctgcattggtgatctagatcaatttttttctttctacacagttaaatttgattggaaattataaaatttggcaagtcgcactttctatttaaccgactcttcttatttaacgagtttcacttagttaagtgtagttttgaataaatttcaatcaaataacatataatatattaaaagaagtgtctcattttcaatcatgtgcatatttgtgatgattgcattttgcttaaatagctggggatggcaagtgcggtgcaaactgtgtgtggacaagcatatggggcaaaaaagcatggagcaatgagcatcatattgcaaagagcaatcatcttacacattggagcagcagtgattctctcatttctctattggttctctggggattttctaaaggccataggacagtcagatagcatagccgagcaaggccaagtgtttgcacgcggaattattcttcaactctatgcatttgcaataagctgtccaatgcagaggttcctccaagcacagaacattgtgaatcctcttgcatatatgtcagttggggtgttccttgttcacattcttctcagttggctagttatatatgttttgggatatggccttttaggggcagcccttactctcagcttttcttggtggcttcttgtcttgtttaatggtctctacatcaaatttagtccaagatgcaaggaaacctggacaggcttcagtattaaggctttcaaaggaatttggccttatttcaagctcacagtagcttctgctgtgatgttatggtatgactatatgtcgatgtcctcataattttctctacatgcatgcctagataaatgagtttaatttctttgtgccgtcaaacacagttaaaccaatcagaaatcactttagatataacttttaagtactgattattatatgtcaacaaacttattgcacatgacaatttgtaattggatgataatgtaaaaacgtcttacacagtaagtgcattactatttagtacatatttatttggatttcaattgagtgagctcaaaagtacttttgatcccaaatcattaaaaccttcattcttcattttgtgcattggaaatcacaaatgtgcatctcaaaattacttttccaacttttatccaaacataccctacataagtatacacatcacacaccacattattattcacatcaatttgttctactaatctaaaaatgtatcttaatgtagtttggaggtatggtacaatcagggactggtgcttttatcagggctgctctccaatcccacaatctcactggactccatttccatttggtatgttaatattttttcttggaataatttttcttgttatgtgccaacgtgttgcctaaccataatatctttatcctgatgtgctttcagtatgaattacttgaactgggacatgcaatttatgttaggccttagtacagcagccaggtttgcaacaaaacgatgtgtttttcattcaagcaactttctcaaaagcatgctaatggtagtttccatgattgcagtgtccgagtcagcaacgaattaggagcatcacatccaagagtagcaaaattttctgtcttcgtagtgaatggaaccagcatcctcattagtgtggttttctgcacaattatcttgatattccgggtttctttgagcaaacttttcacttctgactctgacgtcattgatgctgtgtctaatttgactcccttgcttgctatttctgttttcttaaatggcattcaacctatattatcaggtaataaagctataaaaagtacactagcataagcaccaactttggtttatcacacttttgttaatttttcttggaaaatttcaggggtggcaattggaagtggatggcaagcagtagtggcttatgtaaacttggcttcttactatgttgttggtcttactgttggatgtgttcttggcttcaaaacttctctaggagttgctgtaagtttggaacatctctgtcactaatttttaagtttgtaactgattagtttcatgcaatgcattttgtggtattgttttagggaatttggtggggaatgatccttggagttcttatacaaacagtaactctaataattctgactgccagaacaaattggcaagcagaggtaatcaaaactctacatcagaagatcttatacatgttatattacatcaattttttgtcacatgtgaggtggtgaaccaattcttaatgcctttgaaggttgaaaaagctgttgttcgcatcaataaatccgctgaaaatgacaccttagatcaactggttgctgacacttagaggcattcgtcttttttcttcaggcttggctgaaatgcattttagctgcataggaatcttgttttggactaaaggaatgttgttgatgggtttcttcaccctatttaattttatgttttgttcacaattttgagaatctaataatgaaacctaactttcactgccagcataagtaattgacatattattgcgtggttggatatgtgtttatacagtttattctaactaaacatgactttgcagtaatatgatttttgttttgataacagatattagaaaattaatttgacacacaatgttatttgaaaatttgtaatcaaaattgatttggaacgtaattaccaaaatttcttgagtctaactaaggatatgcatgtaacaaataacatgacaagggtatacatgaacaaataacacaactctagttagttttgacaaaaaggcctcatttcataacttcaaagagacttgagtctaaaacttataattcatgtttctaatataataccaaacatcatgatcaatgaaaaaattatttgactcattttaacctcaaacttagacatgttaaatgtggatccaaatacacattagtcgtaattatttacaaaattatgagttttctttctaatataatgagtatcaaccataattttgtattttttttaataaattttaattaataattaaaagtatattaaaagaatgtgttataaacactaatctaattttaaaaaaataaaagtaagaaataaaaagtaatatttttatgaaaaattaatttgctcttaacactattttactatgatttttaataaaaaatcatttttatttattaagttatttatttatttagtataggtcgcatcaagagagcagcagaaaatgagacgttggatagatcaactggctatcaacaaataagaggaattaagaaataatagtaatacactgtaacatttttttaacacactcttgtactcttttaaacaaactattcattatcattaactgaaattgattcaaatttataaaagtttgcatgtcaaactttatttaataagtcttacgattttataaatttcaataaattttaactaataaaatatatatatattaaaaatgtgttaaaaatgtattagaaaatgttattacttactaatattccttttatcttatatttttcagacatggtttaaaaagcattctagctgcggattaatcttgtattaggcctaatgcagaatgaaatgtaaatgcatggttgagaaaataatgtacaaataattcctttcggcttatgccccgtataaaatgagtgaaatgaattgtaatgttagttaaattagcctaccataccaaccaaatccatgcattcaaattgaaatgcccgaaaaaggaattaaaaattggagataagttagatgataaaatggcattattattggctaaatccgatcatgaattaaactaaaatacaaattccttaaacccattttatgttagttttacctatctctaattatctttctttttcaaatatacatcaacttcattaaacagcgacagaatcagtatatcaccaagaattaaacaccaagccaaaccttcaacccagaattgtgcccattgtcaacttgtgggcaaatttagtacctttcctaggaacaaagttcaaaatacattcatcaaacaatggcagtgctaatcttatgccctcataaataacacctagttcagaccaatctgttacatttctattaatatcacctacctttttgcaatcactttcgatgataatggaactccaatcattgtgagcagaaaacttcacaccatcgatgagttccgtatgataaatatactgttctggatgaattgaggcacgaaacatacatccatgtatatatcctactgttctaccggtctacttacaatcattgtgcaaagttcttcaacgataaaataagtcctaaatacggtagagcttaaaaacaacaaagaaaacaccaatgcgttaccatattattagcaactataactaaaagtgagtgcgtgtcattccaaattacgcatttctgcgttattaatgagattattcatactctaggagtcacagcacctcccagctactcaagttcaacacaacatttgacagtggatgccacccggaagggggatgcataaagcctcctgagattacaaacgagagatctggagtggtatcactgaagcatcctctcccattaccggcgggaccaaatctagctccccataacgctccaggacacgcatcctgcagtcctcagcagccatcattccagtagagtatgccccatgcacagatcccgtatacaacatacttgttgcttcccctgcaaagaataaattatctacagggacccgtagcctctcatacaggtcatgtggtttcccaactgcatcatagctataggaacctagtgtattaatatctataccccatcgagacacaagatactgaatctgcatgattgaaacaaattacatcttcaaaacaccaacaacatactagtcactgaaaaacaacttattcaattcaaccgtatagcaattgtcaaagaatatatgtaccggaactaaactgagtaaaacttaggggtctgcaatatataaatatggattgaagcatttacttttcttgcatagtaaaaaagtgaaataaatcatcaaaattatcatggttaccggtgaagaagcgtctggtaggatctttttgagctgcgtgaaagcaaagttagcagctgcttcattagacattttctcaatgtctttggccagctgcccagcaggcatgtaaacaaggacaggacgacccgtagccttgtggagattaagaaagtagctgcatccataagatgtctctgcaactactcctaggaattccacattaggccagaaaacatttttaaagtgtaaaattattttattctcaatcccaaccccaatatcagaaatggcagcttctttccagtctggtagctttggctcaaattttatccaagatgccttcagcaccccaagaggtacagcaacaatagcagcgtctgcaacaaatgttttcccattttccactgtcacctttacttcattatattgcctaactatttttgttaccctgagaagaggtattatgaatgccattaaatttagttaagcaacacaacgggggaagcagatttccaaaaccaaactttaaattaatatatacctgtgtcccaggcgaatatcaagacccttggctagggtatttataacaggctggtaacccctgaccataagaccgtgaccaccggggagtaatacttcctgtatgcagataaacagagaagaataagtaatacacgaaaaatgttgatggatgcatgtagtaattaacaataaagtagcaacataatgtgactatgatcaccatatgaagccacttctctatctcatattgcatcctttgcatctaatatggcggcacacattaccatttaatctcaaactcaaacctatagggcataactatgagtttgcaactttacgagcaacattgtattcaattataagtatatacaagaacaaaaacaacaacgataaatagctgaaaaagaaaaagtttcccattcacatcagcccactagtactacctattaatgatttgtcatgcaattcaaatttcaatgacataaacttgaaatggatatatagataatagaacccaaacatctcaaacttggttttgtcaaattacctgatcccaacatttcagtgatatggtatcagcatctgtagcaaaccagccctccattctgcataaataccactgtagcaccttgtgggaaagcccttccaacctgcatccaacagagaaaattaaattatacattacttcagctctaagaaaatcaataatggtggtcaaaggattattttatgccaataatcacctcaattccggttttctttcaaaaacaattgaaagtgcacggagtatggacatatcttcactgaattcctctcgtacattatttgtctgcattaaagcagggtcaatctttagaggtgatgttcataataagtggagttgaacattaatagaatcaatcagaaaaaacaatgtattaataagcgaataatcaatcagataaaccaaataactagaaatattcaattactcgcctcttctaaaatcactccaaatattttaccaatttttgctactaactcttggggaacttgattcccatccatatcaaaaagtgcatagctgcaagaagttgatgaatttctataagaaaaaacttgtatctgataatatataccattcagtataagcaaaggataaattgaagcatacactaccgtcaccaattaattatggaagtacagcagaaatagatatctaatatcatttattataaaaaaaaaaaaaaaagagatacttttacctttccaaatcatggtcataaaggacagaattatcctcactagtacggtaaagaggtagtcccagcttcccaatcaatggagccagtggattctccttgcaaactccatgcaacctgaatcacagtcatccatttttaatactaaaacatggagaaatgcaacattcttgtcaacatgaagaaaaaaaagagaacaaagagagtaagctttaccacgatgcacccaggtcaacaggaaagccaaatgagtagtcagtgtgaattcggccaccaagtctttcccgtgattctagaagaataaccttacaaataaaaagtacaatttatgcaaataaataaattaacaagtacaaaagtatgtatgttcaagagggggaaacaaaaaactttaatacctgaaatgaggcatcttgaagtgcacgagcagcagcaatcccagccatgccacctccaatgacaataacagatggggacctctcctgctgcttgtcatcatttgcacagcaaaggcctacaaggaaggaggagagagggaatccaagtcaactttagcagatacacaaaaatagaatcaaaacttctgaaaaaagacaattctcagatacacgagctggcacaagaacatttcacttctaactttctgtttttataatttggaggatgacccaagagaatatttccctctacaaatcatacactcatcattctgttctgaacctacttttgagtgctgcacgtacttttagagaataatcctctttgtatctttcattctgaacacatttgaaacaacggtaatccaaacatacccaaagtcgtcatcctcacacctagattcgaagagattgcaatctaattcttccaatcactttcagaagctcgattgttagaccccaccagccaaaccatctatttcaaagttcaaattacgcaaaaacgcatgcacgtgttcacattactctttcattcgtactacataacgaatttgatcaaaatgcatcattattatatagaaaaacaaaactccatgcactggtatctataaaacgaaatcaatttaaactgaaactgtagacacattgaacaaaaaaggcacacaaaaaaaaaacagcgcggtggagaacaattaacaaacctctgcgtaattgcggattactcttgaatcgggactccatattgtgacgaaaaccggaaattacgattgagattggttttagcgttgatcaataacaagggttggagggaaaggagcgattggggtgaaaaatggagggtaaaaattaagaaagaagtaatgaagtgaaaggaattgaaattggagaataaacggagtttcccaaaccagctcatgcagctaatttttgcagagcccaaccactctcagctggatcggaacgcgaaggtaggggagagaggttggtcggggtttggtttccgagaaaattcagagaaggaaaaagaaaaggaaaagaaaattcactcattcatataattggagtgtgattgggaaagaaagtgcattgcaggttaggtttggtttttaatttatgggattgctgcttgcgttgtgccacccaaaccgacgaggatgccgaagccacgcgtcttacatctctttctttaaaacctaggcatgtaaatgggccaggccccctgttaggcttttggtcaagtgtatttaatgtctcatttgatttatttattataaatatgaggttaaaatttttaaaaaaatttatttaaataaaaaaggttatgttcaaacttaaaaaagtatgttaaatttattatattgatctatttaatatatatattaaaatttaaaaataatatatttatttttttaaaaaatattttttttattataaagatggagaatgatcaattactttaaaaattattttaaaaatttcataaaataattattaattatttgaaaatataaataaaaaatattttctgtttaaaatttgtttttttaatttttttaaattgatttaaaatattttgtaaaattaatttttttattaaaataaattttttaatagatttgtacatcaaattaaatttttaaataattcaaatcaaacttaaaaaaattataataaataaatagatgatatcaaattttatattttaatttaggtatttttcaccccctttacgcgactttgtaactcaatcataaggcttcaaaaagatctttcatgattgtacaattttggcattttaaaatattttattcaacatctgggtgttcacgtcttcaatttttttatattaaacttaaattattgacgtgacattcacatggtattatgtgataaatgtcatagtttcacatattagttatgtgtccaactaactaaccatgttgatacgttagtgttaatatattatgttaataatttttattgaaaaattaacgacaaaataatgatatacttaaattcttaaattttgaaaacactaaaattaatgctatgttttttttttatcattcaaattgcaataacattaattttaatgtagttcaccgcataagtaataaaggagttgtttttcaaaacgtctatggaagacaagaagaaaaaaaatacactaatgatatgtttggttgtgaaaaataaaataaaaaggaaagaaatttataaaattttgtgtaaatctcacatatttttttctatttaaatttttaattctctgtcattcttttttcttctttccaacgaaatcaaccataaatatggaaattaaaagtggatttaagtcatttagttaaaagtctttcaataaaattttcacttttggatggggtcaaaatttggagatacctcgaatctcatcagagagacaacattcctaataatgatagttaaaaaaatgtttcaaaaattttttcaccttttaaaaaagtaatttagtaaaaaatcagaaaaattattttaagaaataacatatgaaaaaatcaaaacatttaattgaattattttaaatccaacttatatataagaatcaatctttatgagaatacttgcttgtgtgaaaaaactttaataattttcataagggtatttttgttttaaaaaaagaatttaaagttgaaggtaaacttggaaatcaggggtgcaagaataccaagtcccattagatgattatgtatcatagttagaagtgagcccaaaagacttggtcaatgatcaccaactatttatttctttgacaaatgctgaccaagtatctttgagtattgattaaaaaattaaaaagagaaaaaatttattgaaacacataaaattatattatttataacttttttatgttctcttgtgatttatacaataaatatttattcttttttagtttcttaacaaatatacacagattagaaagaccctttttttaatactccttttagactcaaatataagaagaaaaaaattcatattaactaagaaagttagttactcataattatttgtaccaatttcaattaaaaaaatattttctaatttattcttcattgaaatttggtaccagaaatttttttaaaaaaaaagtcataaaagcctaatacatcaattaaatgaagagtattttaaaaatgataacaattaattaggaaaaatatagttggaattttcttatatttaagaaaaaaaaatattttattcattatatttaaaaccggaagaattattattttttattcaacggtgcatccccgaacacttactattcaatatacaaggcttgaagtaaaacgattaggcccaattgcagatagtggctctgcagttttgagcttcttaattatattttgggaggataaaccgaaaaaagtaaacccattgggtttctctcttgaataatttagcaaacccctgatatatagaaggaaactaccatggtttatggatttgttggatacacacaatcttcaccttctagatccaatgtttacactcacgcatgatttaacttaactaaagaaaattatccaattagaaaacaaacacagtaaaaactaattcatactaaattaaaaacttagttatttatattcaattgagtaaaatgtatgagtattgcaaatttttgatatcgtctttaatttctataaataaaataaataaatgatataattgtaaacaactaattgttggtgaaaaaatgccaccatattactacatccataagtaattattaatccattgcatttcataaattttgtaatctttgtttccttatattcaatgtatattttactataagcaacatgattcacgagatataaatccttaatttcttcaatgatactactataatttattattttcctcatgctgaaaatgagaaggtaataaatgatgtgattgttgcattaggtgagttatacttgtatgacaatatttggaaagtatatatttgcatgtcctaaaacgttcatgatgaagataaaagatgtgaaagcaaaatgtatgttaattagttgacaccttgaaaaagtgcgataagtgcaaatataatagatgatataatataataataagaaaagataaatagaataaaatatttatctgaaataatcttaatttaagacaattaattatcttcatgctgtgtcgagtcattgggacagattttggcgtttggcacgtaaagactgaaaaagacaacagatgtactgcaaatgaggtggccatgttttacccactctgtggttgtgtcggaaactgacatctgctaactaattattcaacttcaaggctccgacatgtgtgtgtgtatatatatatatatataataataataataataataataataataataataataataataagaatgaaggttcatcaacaaaatttgtgagcaaggaggtataccccacagttccttgaccaatcggcaaccagccaaccactcaaatccattaaacatcaaaatatatgcagccaaaattaccgacatcacattttttgtttgcagctagctgaataccaatgtctactaatgatatgtttggaacagagaatcgagagagaaatgagaaaaaaatacatttttttcatttcagataaataattttttatttggttatcttttctcaaccttccattattattttcttatattatataattctcctaatttatgaataagagacttggggtgacttttactttgttctttatttttctctcttgattaatttttaacgattaagatatataatttgtaatgattttttttttattgtagaagagaataaaataatacttttaaaaaaatggaggaactaaatttaaaggataaaaaataaaagtagcctgaatttaagaaaataaaaacatatttatttatttatttaaaaataatataattaccatttatttacttacacattcatcattatatttaaattaattaaggatataaaaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagttatagtgaggtaaatagttatttttgtttctgaatgtgtagaacgctaataaatttatttctaaaagatgaaaattcaaattttagtcctaaaaagtgaaaaaatgtgacaaattcattcatttattaactttcatctgttatcattaatgaaaaagtctcatacgtggtataaatggatgaaaatgtcacaaaaataactgtcaacatggttgttgaatatatttgatcaaaatgtcaataaatttccaatagaccaaaatatcaataagttttcattggactaatttgtcaaatcccaaaatttgttacatttaagagtaaaatataatttaatcttcatcttcctcccccttttttattcattgaaaacataacattacaataaacacttaaaaaaataggaaaacaaacataagttagaacaaacataataataaacataatacgtctattgctatgaaatttctaatgtgacattattttacccaaaatatgagactcaaacaataatgcacaaccattaagttaatccttaaaaaaaatgagctccaacttgattttgtcattatctaatattgtcacaatagaaatttcaaagcaacagacagattatgcttattaatcaatattatgtttgttctaatttatgttcactttcttattttttttaagtgttttattgtaatgttatgcttgtaatgataaaaaaagagaaaagatgaagattaaattatattttattattaaatgaaacaaaatttggggtccgacaaattagtccaatgaaaatttactgatattttggttcaatctatttaacagtcatattaacaatcattttgtgacattttgtctctttgtgtcacataagttctttaattaacgataatgagcaaaagttaacggataaacgaatttgtcgcatttttttttattttcaaggactaaaatttaaatttttttattttttatcaataaatttgtcatcattttatatattcaacaacaaaaataactatttactcattatttatttttagtaataattatgttttgactttttgacctattaagaagtcatccatcccgattgcttcgacagcgaaactataaataaagagaaagaaagccaataattagagccttctattttttattttttttacatcgctattagtggcagttagttgattaatttagctatgtaatgtgacaatatgaatattccagcgattattcgagataatgactcctaagttcaatttgtgggtataaattaacaccataatgaaactaatattttcaccaaataattggtaaataaagtttgtgagagttgatacatatcaatctttttccaacatgcaacttcaagaaagagataggtgtgtgggaaaagtgaagagaggtatatagaggaagaagctagtccacatacgacgaagttggatggcacgaattaatcattcacctatctattaatattaatattataattactaggggaatagagtccgtgcctctctaaaaaatttaaataacaaaaaaattggaattaaatataattaataaaaaaatgatagaataaaaatatataaaaataatgggatattaacgtaagttaagagaaaaaattataatttaagaattagtttaaaggtaaaattgtacaataaaaatgaataataattagtaaatgattccctaattttgattagtggataaattttaatcagcataactaaagaagattaattattgtcactatattaatatctatactaatagatagaagagatattcactgtgtaactgcttttggtctccacattttttacactattttaccccttaactaaaaacaaaaatcaaataatcacccattaaccactcacatttttccactttgacaccattttattattcatttatatattaacattaatattaattaggctctctcacccttcatttcaattattattagattctgcctccattctttttttttttttttctctctacgccttcttcttcacttcctccttagtgtttgttacttcaatttagtgatttgttctttctggattcaattgaggaaaaaaccgcatggtttgagcaatggatgttaaagttgcacaaggttacaactttcagtggtggttcaactcgaaaggattggaagaagaccacctaacatatgttgtttgggtgtgtcttgggaaccacaaagcttttgggtttttattttgttaacgatgatgcgtcgcaaaagaaccgctttggaggtttcatgttcttacgacaacatttcagatttccattctaaccaataatcccatcatgtttatatatatatatatatatatattaatttttccactgctggtgttgttgaagtgtcattttgcttctatttttatttatttattatttaattttggcgaaagaattgttagttctgagctatatgtctttcaaacaaaatgaaggattggtaattgcatgcgctaagaaggtataatgaagtaatgaatcatactttgtgtaattttgtgtttttcttttctcactccacaataatttttctgtaacctttttttatctactttttttctttctcttctccttctttaactttatctttcatgtatagttcttttaagtataaatttggtttacataatgtttacatattcattttgataacatttggaaggatggaattaaacatgacacacaacacacaacacacaaaaaaatatggttataattcatgcaacattacattattgtcttgcatgcaaagcattcaaagtcttcttcttgatcttttttttttatttagaaaataaaccgaaattgattaattgtttgaatttatgtaagttattaaaacannnnnnnnnnaaatatttttaatcatcaatcaaataaattttacttattcctataaaatataattttcatgaatcatgattttcgaacataaaaagaatttcttccttatcaaatgccggttaagtttaacatgtaaaacatattgtttttatttttatccttaatgttgtaaggcatagaaactatttgaaagatgcgtctgatccattttttaaagatattttataaattatttaaaaataaagtataaactatttaacaatttttagtttccttgaaaaaacaattttcttgtttcctttttaagtttaaaagatattataaagagaaagaagagaacgtatcagataaaacagaaagtagagacaagaaaagagaaaaaaaaagcaagagaaagaaaggagagagagaacatgaaaatagaataaaaataaacttttgttttgttaaaagtgctttcacttaagtttctttattattttttattttaaaatgtaattaaacaagcaaatttctttttaaaaaggaataaaaatccaaaaaagttggaagtatctagtgcccttacctgctttgccactaacaagatcatcaatattagctgttcccctcatgggtccgctgctattattgcctggtgcaatcattgtttgactatgttgcactgcttgggaaccatatctgaacacattcataggctgcaagataaaaccaaaaaaaataaaattaactaacaatggtgattaaaatataaaaaacgttcatataaagtttaaaagtttattggtcatgtgtaatgacagtataacatctcatcacaaatgtacttttaaaactatcaaatttataattagataataatataaaattattttactttattattattattattatccagatataacttttcttctaaaaaaataaaacaaaagaactaaaaaaataattggtgcacatgtaaatatcaaatgattaagtaaagcaaagaagaatgaaaaaatttcacttgaaagaacccaattaaattacctgagaggcacttcgcatgagatggtaacccatgtaacgtgcatattgttctggaaggcaagggttttgcatatggttttggtaattaacggcacccaaaacttgattttggcacattaaattctggtttggcatctgaggcacagacatggcttgaccatgtggtacatttggcaattgcatcgggttgggtgcacccattcccatacccatttgtgacatatagtgctgaattcctgggaacatcactggtgtcatgccaggccccatccacattacctatcaccaacaacaaaaaattgtcacatattactatagtgttagaatatatcatcacatgcatgcatgtgtatgtgtaagttgtacctgaagctgaaactgaagcgatttcaagtattcgattgcctcttctaacattgatgctttgtcagtctgcgcgtacaacccattgttattttacaccacccatgattgaatcttatgaaaaagtagaatcattctaaaaaaaaaaaaaaaaaagatgtagagtaataccacttttaaccttaccaatcatccgagtctacccaaagtaatattacatggtagaataataatacataaacacctatacagtatatctaatttaattatgctctttattttttgttttttctctctcatcaatagtattatttattatatttatacttttttctcttctatttctatccatctctagctgtctgttagcgtataaatgttcacgcatcgttttcggtctagatgcatgcatctctacagaaaaaagttaacgtagtgacaagtcaacaagcattatttgataacgaaccttgttactgttaggtatcagttgctgcaatgtcctcatcttctcattgatcctatctcttcttctctgcattagtaaaataaccccggtagtaagagttaattaagttgacacaacacaaatcacaaaattacaataaaaaaaccatgcgctcaccctttctgattgattatgcacttcagctgcacggttccttctggaagaccccgtccgctgagaagccttgtttccatcagctgatttaagttctgtggcctattacaaatgtagacacatctcatcagcctacaataatgccaacaacgaatctttttttgagttatcatgtcttctatgatagttttacttatgattagtcattatcagaaaacttgcattggctgatcatctttaccggacttcacttctaactactcattttctatttacaagactctaatatgagaccttactatgaaatccaaatctaattcttctcggactaatgtaatgttggtgcaacaagaaaatcttgttcttctaaatgagaatagttacatggatcacacatgtcattcaattcaatttttgactaaatcttccgaggccatcaggcaaaaagaaaaaagcaagcatgcattcatgaatgtaaatggaaagaggaagagcatgacctcactttgttcctcagatgcttcttcttctgtcccttttctcttttggcaatgatctcttgttgatagggaacaaattcttgcaataccagtactgcctgagccaccggaagatgaagtcacagttggttcaatcatctctgatttttctttgtcactactaggacaaattggtctctggacacaatctcttacagcttcaggctcagcagataaagtaatattattagtagtggcccaaacaccactgcttgaaaccctgcttacatcttgctcctgagggatgtgattgctgccactgtgacttgaaccacctgtgatcactgagtactctctagcctcactttgtgacaagttagcagtagtttttcccctaaactgtgtactgccagatgctgaagaaacattattaaggggtgttgaaaagtgaggaaaatttagaacctttggtgatgcaccaaagtcattgattttctgagatgaatcaggaacatgaaatcttggagcaggcataggaataggattcccttggattcgttgaacaaatgaggatttcatgttaggtggtagtggttttgaacttgaagtagtaggatgatggggggtactagaagcaaaaaaattggcaaacttgtcctcttccaattgcttgattggcttgtaagattcaaattcacaagttggtggtagttcagataaaaggtttgaacaaaaatcttgttccagtgggtcctcaagtgggaattggatccatggggtggcctgttcttgatccaagttgcttgagtttccatagggaccactagaccttaatgttgaatgatctgttttctgcacctgtctcaagttagatgaattccctagtggcttcctatgtgtttggttgtgcctcacaacttgcccattttgccataggagctctacaagttcttggtccggcctgtataattgaccacatagagaattataatcaagccaaagttaatagggacattatatatcctgctttgacaaagatagataacacacaccctatgagctttctttggttggtgagacatgcatcactctcaaaatcccaaccaggaatactgttcttcatggttcaccaaatcagttgtctgttggaacaagagaggagagagaactttagacttagagcagactttataagcagagtaaaatagaataatctgcaaagttcagctaattgagtaatcaaataagcatatagaatttttgaagtgaaagaaaaaaataataaagaaagaaagaaagctttcgggtcaagtgtatgcagcttgacttgccaagagggtgaaaaaccaatgaaatggaaccacaagttggattttgccattgtgatcaattgtgtgaataaataaagcaaggaatgtttaaactccaagagacccggaaaggaaaattattttcctattattacattacatttgaaagtacatgcaaatattgattaacaagaacagaaaaagaacaaaacactaaagaaatacaagaactgaaaaaaataccaaacttttaatcccaacaaagtgggaaaaaattgacagagttagttggagagctacactaagtattatctcaagaacatttaaacacatacacttcaaaaacaaagaagaaccccacctgagttaaggtaaaaagagtttttcttttggttaaggcaaaggctgcttttttgcaacttgttgaatagaagctataaaaatagatgctaactagagactgaagaaacaaaactccctctgaacaagtgctaggttcagcttgaggagtttggtgacagaggttgtggcacagtttttaacaagaagaaggacagtgacatatccaagttagtacaaagagagaagagagcaaatatggcatgaaaaaaatggtactaaatagtattgtgcttgtcaacagcgagaaaaacatggctagctgcacatgtggcttcagttgaaaccggggtctgcaaagattttgctgttcaatatgaaacgcaaacaaggaaaatccaattctccatgcacacggtggatgctatctgagagtgcattgtgatgacgtggcggggacaaggtgtatattattggagattgataaggctgaggcattgtctgaaaaagaaaggaaaaagatgtggtacaagtttcatgctcatctagacatcaactaatcaaaggcatcaactatctaccaaatatacaacctgtctcatgagtccatttttgtaacatggtcctagaagaatactggccaactcagaaattttcattattagttcaaacgagtggaaaggataatgcagaatctgaattctctcttgatcttaactagtatgacataataagagattttttttttttaaatatcataattacttgatgaatctattaattgtagtagtatttgataaaattgtatatatttttttaaacatgaccatatatcatgttacttatttttgtgtgtgtgtatgaacttgaatattttgtggctataagttagagaccaatctccgaatccattcaagagattttctatacacgtgaacatgagaatcgaatacttaatattgtaggtaatacaagatttttatatatgattcattatgtactagaaagtatcctttcatgagtgaaaataggataacattcaaagcaaatagcctttagaaattttggtgagccttgagttaagctcaaatcaaagtgtataacttgaactttgtactttggataatatcttgcatgtgaatgatgtaattattcggttttattgggtcgttagcatttctatcaaaaaaatctaaaataatgaaaaaaaatagtccgtctatgacaaaaaacgaaaactagcagacgaaagaaaaaattggtatttcaaagacggtatttagatatggaattatccgtctttgatttgtttgtctctagaactgtctctatattgtctagttattctcagggatggatttcggagatagaattggtccgtgacaataattttcgtctctaaatttgtctttgaatatgcattttgagttttttttttataaaaaaaataactaaaatattagagacaaaatcattaggtctctaagtttctcttatttatttattatcatttttaaccatttaattcattaaactcaaattttcttatgatttgtttgaaatatataatatttaaaggagtaaaaacattatcaatgattaagaatatttttattaattaagagaagtttcttcatctatcgttgctacattgttgacaagtagccttaggaaaggctgaatgttttcttatttttatacacacatttaagaatttttgtattttttatttctttttacatttaattatgtttcatattttaaagtttcaattttctttattcttttatgctaattctaatagaaaaggcacatatatcatcacactgttactttctccatcccattataattatcatcttatgttaatttacacatatcaagaaaaattaataaatgaacgacagagaataacaattttacaaaattaaagttataccattaattcaattttagttattgtaaccatatcattaatattataataaatataaatgaaaaaagataattaatattatattaaaaagttaaaataacaattattttgagataatgtttttttcttacacgataattattataagactgaaagagtagtacacaagcaaaaatgttttgaaaactaatgaagaaaattctaattgtattttagttatacctctattcttgatattattaagtataccaatgatttgtttttagaatttgttgtaattaataatttttctagatactctacttagaaaaactaatgatcacaccaaatcactatcagcataattagtgatccagagaataaaggtaaaattaagatataatcaaaattttcttcattaaaaagtaatgttaaatataatgttaactattttatgttcagaattgagataatggagatttagtaaagttgcataacctaaatttggtgagagacagaaagcgggggtgaagccttgaggtccaaatgacaaagatagttcatagcaaagcaaccagccaacttcttcaccgcaccaaatgggataggaattcctcaaatcagataccaatttaatgcccacattcaatgttatttgcccttttctggatacatacatgtaaatcacttccttcatccttaccacttcatttttctttctttctgaatcatatgtatctttcaccttgatataattatcttcgagttaaatagaattattataaatgacataattatttatccaggtatttaatgtaataagattttcaggattcaaacttgaaacatctgattaatttgaaataatttcacattaattaatacatgtacttgatgttctttacacttaacttttttagataaatgcttatttatttttcaaaaattaataaaataacgtatatttttaaaaataagtttaattaaatatacattgagttttatcaaagtatcagcccaaggccaagttccaactcgaaagtcgttttaccttcaaggcttcaaatcaaaatcacccaactgtactttagtctttagtgtagcagaataatggtataacataaaaataagatgaatgtaaccttcaagcattcttatcatatgaactctcgtgttactcaccacattcacactaaggtgtgtacgtgcatattaaattgtacatgcatattaaattattaataaagaccatggtagaaaaaccacgacaaataatgttgtccgattgctattaaagtaaaactcaaattcaacggaaggacaagttcatgaaacaaatttaaacacaagtgtaacgtgggaaaggtgaggttagatctactaagaagtaggaattttattcataattgagttaaatatatttttagcttttgtaaaataagcaaattttgagtttgatcatgtatttttttcatctctcaaaatataaaatcattgtttttgatatttttaaaaatatcacttttaaaattagattaaattctaaaaaaacagagtggtgtcattaaggaagccttccgtaagagaaaaattacttaggaatcaaagagtggacagttcaaattgggtttgataacattgattaaaatcttaatataaattttttaggaatcaaagagttattcaatatttttattatattaaataatttaataaaaagtaagatgatatttttgcggtagtaaaagaaaaattacttgaaaaagtaagatttttttcctcttgtgaaattttttcgtgagaaattaattaaaaacattcacagaaaatattctttcttaggaattttattttttaaaaattgataccaaatatggaaaattaagttttccaacttatgattcccggaaagtaaacaatttatctcccaccaaacacttcctaaagaaaaaactaaaaaagtgatacaataagaaaacgctagcagacattgggccttgaatgcgttattcacctattatcaatccaggtccatagaaagaagcagttcagtttttccggattcggattgggttctcattttggatcttaaccgaagcacactccgttacgtacgaagcatcctaatagcattggcggaaaccaccgttcgacgccggagacacgatctgtttcttcctctgacttattctcttcaggtaattaaaaacacttttctttctccactttttttcttcctctgactttgcaatttttcacttcggaaacatctacatggataggaaatagaatgccaagatgttcaccggtaaatttagtcgagaacaatatctaaactgtttttcatgttctgaattggaactttattgttattattattgccggtaaaaaagtacgttgtaggtcctcagttttcgattaaaattggccatgattctggtatggtattttttataattgctgaattctggtaatttttcaaccttaaactggttgaaatagtttgattgatattcagggtgtttgattgcgtttataatctggggtagtttgatcggataagcttttctgataaattttttttttcagtttgatacacaaatacctgtttttctttgcttgatgaagtttgatttttagataatttgtataactactgaacagtgtaggtatgggaatcagtaaaacagaagtaaacttgaggaggttgcttgcagctgctcctcaacagcaaaatcaagcaaaacttgtgcatgtaagtctgaagataaaccttttctaattttattgaaatatatgttttattaatttagattggctgatagtgtgtcttaggacggagtggagaaaaactataagtttggtgaagagttagatccgttattatttctatgttcgagacggtccatttttagttcttttcctattcatttttccctctttctttcaccctttttttcctttattttattttcttttcttttgacttattttccctttttcttcccctcccccttccttttttttcaacttcctcatatctgtcattgggtttatctaccatcgaccccaattaacttgtgttaaagatactgttgatgttgatatattttattaatttagtcatttcttaactctggaaaaacataattaatcatttgtcgatttttggattttgcagtatgttgctactttgcgtgaacaattagaacagttggctgaagaaaggacactggaaggcttaccaaggtattgtacgtctctttatttaccatctgatacacataggtgtcatggaattataattgaaacaatataagtgcattcatttgtgtgtataaatgctctgctatggttatgcaggatttcaaaggctatgttgaatgattattcagagaagattgaagccattgcttccaaattggttaatcatgtggtgtgtatttgttactcgtttcctctatttctcagctcttctgcttatgggttcttaacacattttcactttggatcataacttttgttcaaaatcattttaattttttaactccgtcctctttttcacctaattaaccaaacttttaggatttattacacaacggagaaaatcatattacattcactatatttttgttatacaatgacagtaagatattaacccaagacatcatgcaaactgtccaaactctcagctagtggtttataatatgttcactatagcatgtgaaaagtgttgcatttgatggctgtatttttgttgactttgttggaaatatggaatgcatcatgaagttgtaagctcctttttggttttttcaatttatgtaattttagttttggcctaataagcacaatcattcaaccacagtttttttaacccagattgacacacaagtacccaagaaggacttcgaaaagaattttgttaaagaaaaacattctgaaattgaggaaaaaaagcagatactcctttcttctggattgagaagaaggcctgtgtaagctaaagttagcctttcttactactatgtgtattttgtaggctgttttactgttgctcatctgattcattggacagacctgcctcaagtacggaagataaagcgcatgagcctgctgagactgaccacacatcacctattaaactggatgctacagcacatgcacacattgaaaagcacaggtactgtttatttgagttgttatttgaagtttatgtaatggtggatccatagactctgtactgcttttatggagagtccataacctacaagctacaaaccttatgttcatatgtcaatttgtctagaacaacaaagtatatttttcttcaggacaagcaccgatgtattaaggtcaatcgttgatacattgttagtaagttaccagtgaccatatgttactagcttaatatgattaggattatatatatttgagagtttatatcgtcttcattgactagtcctgaggatgtttctgaatcattatcattatgataccaataatttccattaaatcatgtgtgctaatgtattagatcaataatttttatagtcatttactgtgctctctagatactcagcatttattgttatcacttgtgttttcatagtttttctgttttattcaatttttaatttagaaagcttcaagaagatttgactgatgaaatggtggttttggcaaaacaactcaaagagagtagtctcacgatgagcctgtccctgcaaaatactgaaaaggtctcgaatctcattttcatttaatcgtgcttgtcttactgctaaacagttatatgaattggttgtgggtggcttgctttgcagatacttgattctacagagaaggctattgaacatagcttggcaagcaccggtcgtgccaatgtgcgagcaacggcaatctactcggagagttctaagacttcttgcttaacatggcttgtcatgtttgtcatgacatgcgtatttgtcatggttattcttctaatccgtgtcacagtgtaaaagaaataacttccaacataactttttatattttttttccatagaaatcgaagacgttgtcaatgtcaatatgaggaattttataacaattcatacacttttatttaaccaacttaaccaactaaactagactctcttaatccttgtcacataatctaaattaaattgaaaaatgttaacattagttaaaaaaacattttttttcttatgagaaagtgttttaaatgatcttttaccataatctctaatgtagtttattaactgtagttttaataagaagtttctatttattcatttcttaattagtctccttagagcactcaataacaaggctatccttctttatatataaatttaaaactatctatttctttattctttcacgttcattcttaatatttttcttttatgaagtggtgcatttcactctaacatatgatatattcttttatacttttaacttcaattcaacgattttacaaattgtcactgaatattagaaatcaattttaaatacatgtgacgtatatttaattaaattactactagtataacgaagcttatattatttattgatagtttgtttactataattaaataatggttggattatttaataaaaaataataatggttggattctgttagattaaaaaaaaagtgaaagcttttaaattaaaatcaacaaaatcttaactaatattaaggttatgacgttatgtttgacccaattttttaattctattaaggtttaaaaataaagtaaaagttttatgaacatttttatttttttgttgtaaaattcctttttaagttaaaactgtttggtaaaaaaaagtttagatttatttaaaactaactgcctcactcaacaaaataatatattgataaaataaacaataccaaaatgcacaagattgtaattaaaaggtgaaaaaattgaacagggtttctaaacaattgagcactattttcttctcaattttatcatccggttccggtcacaccacatctaaataaaaggctaaaaattatacttatttcagattttctttccatctagcatgagcattgcctaggccattgcttatagataagcaaatggaagatgatgttctgatattatgagatattatgcttttgtgtattttcaatgtaggcaacaaaaaagtcttatataaagtttacacgagtagaaattctgctaacaaaataacaaatccgacaaacagattctatatctataaagccaaataatataatatctataatgtctctttgactttttcaagcaatacatatagcttttggtgtaatgcgctgatgagaagaaaatccagaaaacagtgaattaattatctgattagaaaaggcatatatgatgagaatactctgaatctcaagatagatcaaacacagttgaataattttatgtaaaattgcatgcaaagtgtaaaaagtgctcagctaggtagcttctcctttctgataggattttcctttgtagttaattaaactaaaaggtgaatggggatcattggcttccctcattaggtaacaagatggctaagaaattgtcataaactcaactcactaatttaatttcttctttgcatatatataagcttgatttatgtgttccctgaaccatgattctgccaaggaaaaaatgaactggaaggtacacatagcaaactcttgtatagatcatcataataagtttattaaaggaaaccatttataattgggtgatgtcaaatttatcaaattttcctgcaccccattacaagtacattgccaattgccatcaaattattatatatacaaaaactatgatcagataatagagtcaaagacgatcgacaagaaaattattgggtccgagaaagagaggaattaagccatatataattactaataaaacatgtattatgcctcaaatttatagtgaccataattaagcataacactagaaactattccaagagtaaacacaaatgtagtgtaattactaagcaataccacagaatgaagcttacactgactactactatatccctcctcctcctcctcatcaatgcatgtcttgcgaaattcttctatgccgctggggccacatcaatgactccattatcatcatcgtcatcatcaccttcatttgagatacaaaagttgtggccaaattcatgagttgcagcccagtcattgcccaagggcacaccatattcttccttgcaaataaagaccaccattgttacacagatatatgacagaatgaattatactataaaataaaagactgcctcggttgtgacctaggttacatttatatatacattagaaatttgtatttttaaaataaaagaaaagaaaagataaaatatagggtggctagcttagtagcttttaatatattgcgaaatccaaattggatcattctaccctttacaacacataataacactttttataatttatttattttcttatctcttttcattccattgttcattttatttatctctcttcctattacttcatattaacggttatatatatatatatatatatatatatatatatatatgtttctctcatttttctttctttcaactaatgggtgtctgctaattgtttttgtattgttttatacttttgtatttttctttgtttctctcttaaatttctgaaaaaaattgtgtgagaatagcatttctcttggagattttctgaaagataagtttgcctttttgttctttctctactaccaacgagctaggcacttttaattttgttttcttgttagaattcaacgttctttatgagtgcaaaggaggcaatggctgaggtggtgaagcttctgaccatacaaatttccatggtggacaaaacttgaggcaagctcatggcttcatgttgctaaatgcatttaacatgtggagttaagtgctgcacacacgcttgagcttcaccgtcacatgcacttggatgacatggatatgccaaaaacagctagcccacgaaagaaaaggtgaatgtaaatgccaaagggtaaaaacctttacaacataggttttggccaaacatgatcatttgagaggaaaagaggattttcaaacacgtgtgcttcatcattcatttctccctcgtgactactcaaatatatcacacatttgtggcttaaagcgactgggttaggtacatatattataattttattttttatgagtagtagtggacatttctttcctctaaatacattgttaacatttattatttttttacatgtacaacaaatcttaaaacaaagaaatagaaaggaagaaaagtgagaggggagagaaattttaaaatataataaatgatatgataaagaagatagacacataaaatgataatgatagtgtataaattgttgtacatatatcatatctcaaaagtgatgttagacttaaataaatctaactaattttgctctatttaatgttatcattctaaaatattttttatttaatttttaatttttatttttaatgactatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaaagtatacaaactaaaataaaaagacagttttgggttttctccaaaactaaacgggatttggcagagaaaaacttttacactaattaataaaaaaaatgaattatccttaatagctttatttgatctttttaaacgaataatagtcgttttgtttatttcccggaccccttgtgactcaaataaaatactttccctttcttaaaatatctctcctctcctcccatcccctacattagtcttttttatgtattaggttttaaactggggtagtatcaaacgccttgtaagtggcttcacaagtttgcaacagtcattaatgaagtcttgatccccagtcaaataatgagacacaagaaattctaaagaccccaacatagaattgttccctatttacattacatccttcagcctttcccagttccatcacaagtgagagaaagggatattgaaaatcaaaccatttacataaggaagaatctattcatacttctttcctttgagctttcccttggggattttgctgagcaaaccagtatccagcttctgatagtgattttgcatctgatcaaagaccttgtacacaaagttgtcaacttgatcctgatacctttcatagagaactgggagtgtatgtgcagcaacaaaaccttagacataacataatagaaattttagcaaatcaggtatgacctgaaaagtcaaactagaaggaaaaacatcatcgttgaacttctaacaggtaccatatcatccatctgaacttcaagaagaaaaagatccactatcccacaaaataatatacatcaacatacactaatatttgatttcaaataagatttggtaattgaggaggcatattatcagaaaacacttaacaaggcatacatttgtgtgtgtggattgtgttacaccatccaaactcctgactccagcatcttaacaggaatttaacatctttcaaatcgtttcctatgctacacagttatcgcatagacagacaaataacaagcttttgaaagttaatatgtcgttttaatcatccttcatatccatcatacaagcacaacataaggttggctttaccaaatactaatataatacaatttccataatttcaataattcacatttctctgagcaaatatttgtaggattacctgaaattttgaattatatttttcaaactttgtctgacttaataattcaagcagacactctggtcaacacattctaatctatatcaacagatgaaaagaaagcaggtctctcaccaatatacatgacagtcaaaaaattgcaccaactcccaatcacagcaccagcccataagcttactacaacctggggatgttatagccattatcacaaattccacaaaaaaagcatatattttccctttgcaacaaaatataaaagtaaatataatttatcatatataacataaaaacaagttataaaataactgatggcaaagtagaaagtgcatcatcatggttgtgcagttaaagataataaatacaacccacccacattgattctttgtcatataatactactccaagtcatgtaaaacaacctatattgacccttgaagcttataatttaaaatccttgtttccccaattcaattctatcatacctccggctggatgtcagtctcccccacccccaacctacccacacccttcctgggtgccaactccttgtgttttttgctcagtaattcaaatctttggcaacaacaaagtaataaaatcaggaaaccacacaataacaaacaacttaagatcaaatgactcttagaagataatgtcacataaggtttagttgacttggcaagttcccacgaactcaagaaacttatccctttctacatgagtacaaaatagaaattcgaagaagagaaaaagcaattgacaattttgatgagatatgtcaataaaatgtcacaaacagaagatgttgtagcaaacaaaaataaatggaattgattgaatgacaagtactatagcaaatactggtgtcagaaactgaagaatggtttaacctggaaactacattctaatttctaagcatgaacgtggatcgtaaataacaattacaatgaaagcaaacataagagtaaccatacaataagaaattgttttaggtttcctccacatgaaacatcttggagaaacctcaaaccatggttaacctcagcaccaactgcagttgcaatattcacgaagatatcatctgggaggacaaaacggggaactttagatggcttcctgtcacccaacagagaacaaagcatgtttaagctgtaaagtagcataatatatttacataaagtaagacatcaaaagaagagaagatgcttggataacctgctaaacaagctggaagcatttgtccaaataaactgtccaagcataccaagagccacaacaaagaataaaatagttaggaaattataattaagccattcaaaaagcacccatatagctgttgctgcggataaaacgctagcagagatcttcttgttcctccataacaagacatcagcagctgcatcattcaatggaaacccaaaaaaaaagtttagaagtcaaggccaacatgatagattttacaggaaattatctagaactaccatacattttccaccccctaaaatatggtgcacaggtttctggcgtccaaatagtctattgaattgggagctcactgagcttgacttgtcttcaaaaaatgatccagatttttgcttctcagtaagtgtttccacaatggtgtttaaaaggttttcagctgtgattttctcagacattgttcctgcacttctatacgaacaaaaaagaacatcacaaaatgttgcatgaaaatagcgatcatgcctatcaccactgcagcatcaatcaccattcataagaaaccagcacacacgaaatgaatataaatatacaattttctttttcccgaaccattaacaaaagagaagaacatactaccgacatcaagtcatactttcacaaaggcaaaaagttatctcgtctaaaatgaaataagtctaattggtctatggtcacaaaaagaaacatctctggcaattaattattaacttagcctatatgtatttaaggcttaagctacatcaagtttactacttcaaccccattaagtctatttagtgtctgttgttttagattgttattgctgcaaattgggtcttaacttcatagtgtctatagcgaactatttagcattcttgataactttaattattatttttatgcctttttccattactgtcatagtcattccaaggcctgaatatggggctgattgagtttttgacattgtatttgttgaaatttaaaggatttgtatgcaaaaggaaaatggagagcacggtgaatcagtgcacaacataaagtatgttataatgagactctgagtgattgtgacacaaaacacagactaacacctcaatttactgtatttggttgggcagaaaaaagcgaccaaagagagaattatttgaaatattgaagtaaagagaaaatgaatttaactttttttttttttcctcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcttatttcttttttactttcttttcttaattaaaaaacataaactgggaaagcagtaaagaaaaaggggtaccgcaagtttttttcaacccaattgagaagggcatgaaagacgagcatttgacatataatgagggatatgacgaatatacgaagaaattcaaagtttaagcacaagggcaaatccctaactggagaaattttcagtgaattcaacaagacagattagagaaacgaaaaccagtagaaacgcaaaagaggcagcatcaaaggaagaagcagaagcatgaatttaatcaattaaaacagaaaaaggaatgattttcgtgcacaaaccagagaatggagaggagggtagaagcgaagtagcgaacaaagtactactgcaaaggcacaccagagagagagagagagagagagagagagagagagagagagatgcttttacgttggtataatgaatggcagaaagaaagaaagtgtaaaatgcaaaagttactactataaaatataaataaagtagtatttgaaaagagtttagtttcttttattttaactagttgaaaattagacactccatccatgtcttgtgcattctgtgtcatgtgttttatttgtcttttttgttttttagttaaatacaattataatgactatcatgttaaaaagtaattcctttcatttttaattataattttttaactaattcatgattctttaaaaaaattaatttaattaattatattaaatttgtcaaataattatactatcatttcaaaatcatctttttcttatctctattcacttaattgtttattattgatatttggagacagaataactaaataaagatatgtaaaaaaaattaatatatctaaaaaatttaaaaaatgtatgatgaaaaataaaaataattttctgaaaaagataatataattagggagtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattaattttttcatgcgacacaagcttgtttcattttttatttttcctaaaaatatcaaatagacttatactactataaaataatagttatgaattaaattgagtttattaactatgaattgtcaatacaatttttttaacattgtgaatcagttaaaaaaaatattatttatatatattttttataaaattattatatataattgattgtaattgaataatgaaaaaaattaattaataacattattgtatagactattttttattattaattttatattactgtaaatagattttatgctaattattttatgatttttttatttcttaaagtaatgatttaatgatagaaatgtgagttatcaaaaagaaaaaaagaaaatgttatattttattgaaaaacaaaaaacaaaatatgctattttatgttttttttttatattcttttataatttatattaatatttttttttattttcttaactaatatttgaaagacactaaataccaaacgaacaagaaagatagaaatgcagtatctcaataaagaactagtgataattgaggaactcagcaaccacccttcctttgcactagtgttctgaaaataaaaacaaaacgcacgtgaagctccgtcatttcccatttgggatttttggagtccgagcaacgccgtaaacaacactgcagtatagtatactactattcttgagcaatgaccatctctaatgtttgatcaattgattgattaaggttttttttttattatttattttcgtgggttatagtactgcgactatatatgtcaaatttaaattttttaacaaagatttattttactattaaaatttttaacttaatttttaatttaactttgtgtgttctataattgatctcacataattattaacacttctgattagacatgacaacgggacggagcggggtcgggtattgcatttcccgttcccgtccccgcttccaaacccgctccccgcccccacccctgttctccgtcggattttaaaacccatctccatccctgtccccgctggggtcgggttttcgccgctccgccccgcccccgctatttgattgaaatttaaaatataaaaaaataatataattttttattgaaaaattggataaaaaattaattatgtaacaaaaaaataataataacaaactcacatttaaaatatggaatcataatttttaaaattacaaaacaaaatcaatcaatttaattaaaaaaattagaaaataatatatatttttttaatattatttattatggggcgggggcgggggaggggtgggtatcagtaaccccatacccaccctcgcccccacttttggctatcggggaaaacccgaattcgaacccgaatccgaaaaatttcgatttttctccattaaaatagggacggatttggacgagtactcacggatttaaatcccgttgccatgcctacttctgatacttgttgcaggtccttttctgttgattcctaacattggccatataatttttcttttctccttaccacattcgaatgatcttagaccaatttagttcacttgagatatcgataaatagcatatgttagataataccttatattatatgggttctactgtcccaagaattgggaaatcgaaatggcttattctcagttttttatttccacaaattattcctttattatttcaattgttttattttttgtctattaacttaatatctaatatatttaacaacaatattaatgtgacattatattacaccgtcctagcggcacattcatactagcacgatattctatggtatgactacgtcaacacgcagttaatgaagaaattaatattacacaattaaaataattaataaattattaatttgagggtactaaatttgatttctttaaacaatatatctgatttgatcattataagtgaaaaaaagtgatcgttaaaagtagaaatcttactaaaataactagccaaaattccaagcaaaaattattaatcaacaaagttgttaagtatttcactctaatgtgataatgatccaaaataattagatcaaatccatgagaaagaacaagaaacaaaatttataaaattaaaactaaaaagataattaaacttagagaaatattaataatatattctctaatatacttttttatggccttctttattattaattgaaatttaagaaaaacaataaattttgatgaattttacttttgatttaataagggattttataatttagaataaattacacatattcctcttgagacttatccttattatacctaacctgatatccatttattttcacacaaaatcctttaatttttttagttttcgttatataaacctcctctctcaggcgtaaatcgttaagtcgatcctctttggaggaactcaaagtaatatataaaaaaaatgaaatgatattgagcgtaagaagagcgagaataggagaatccgtataatttgctttatagtttttaataacttcaaaacaaataatagaacgtggaattgaaaaaaacacactattagaaactgtagctatgctcttcgacctaatatctaaaacacaaagcgattggaagttggtctattttgttttggaagttagtctttaattacctgaacataatttttcacaaaaatattaaaaaacaagtacttgaacgaatacaagatcatatatataacaaaaagtaatgaatatgacagtgtcttgtcccaaaatgggtatggcatgaggcaaatgagaatacgtgatacgacgtggcaccaatgagagtttctattaccttatcccacatcgacaatctaatccaattttcccaatcatcctcttccaaaatccaatatccaaaatcctcgttgccacataacacattgaaactaaactccaacaagttcctaccatagtctgaggaaagtgaacgagagagagatcacagacacagagaagaatggcttctacacaatgtttcttgcaccaccatgctcttaccacccctgccagtgccagatccccatcacaacgcatcatggttagcaccaagcctaaccagcttgtttgcaaggcacagaaacagcaaacaccacaagaagatattgatgtcagcccaatctctcgccggttagctctaactgtgctcattggtgctgctgctgttggctccaaagtccaacctgctgatgcagcctatggtgaagctggtatttcattgtctctctttttatgatcatgcaatattaaactcaaatgatgataacagctcattagtctttggcttttgaagatgaaatactcatttgcatgattatgatttttttatactgtccactgctcgcaaagatcatgccatgcttcaggaaaaatatgttattttttggtgccatgaaaaatcgttgaccacccaaatggctagctgcaaattgctttgaacagatttctagcatgcatagtaactaaagtgttactataatctacttttgattttgtgatatttgtgaattgtgtactctttactacttagtagggtttaagatgaaataaatcgagtgatcataaaccaccaatcacatggatcaattagtaaggggtttctccagcttaattagtgatctaaagttcgaggtctaggtgtacagttgagttgaatacgccaaaggaatgctttactgccgataatagtcttactcgaatcgagcaagattgccttccttctgccgtagatacctgtggtctatgctaaagaatatagtgattataggatacaatccaagggtaggaatttacataggtcttgatggtggaagtcgataacgaaatcaattcagatgcttagactattttgaaaaataaggtcgctcaaaccttgtgcagaaattataattgaaagaatggagttggcaaagattattagactctaaaataaccatttggtcataaagtcccgaatagcgtgtcaaggaccagcttatgcttatctcaaatgtataagttgttaggtgggagttgatccctctaataataatggggatgacatgatttatttgaacaacttggttgttttgcttgcagccaatgtgtttggaaagccaaagacagacacggatttcctgccatacaatggaaatggattcaaactatctattccctcaaagtggaacccaagcaaagaagttgagtacacgggtcaggttgttagatatgaggataactttgactcaaccaccaacgtggttgtcaccatcactccaactgataagaagtccatcactgactatggttcacccgaagagttcctctctaaggtaaacctgttttaaactagtacttctgtttgttttctaattaataaggaacacttatatatagccccattaatgtacagtttttatgtttctaagtaccaacagaatcactgaaatagtgaccaaatttagtaaagaaaaactgtttatatcactaattctggcaccactaagttttagtgacaattttttttcttcaattgcatatagattattcccttactaattttaacctttttagtatacattcaaaaagaaaaatggtaatatatgaatttttgaagacagtgacaccagtttctactttctggctgaaattcaagatttggtgtttcctcgttacaggtggattatttactaggaaaacaggccttcttcggcgaaacacaagctgaggtaagtgattgatgatcaaacacgatcgaatgaatgcgccaaatatcatcttgcatgccctaactgaagtctgaacttgaattgcacagggtggttttgatccaaatgcagtggccacggctaacatcttagagactgcaacacctgtgattgacgggaagccatactattttctgtctgtgttgacaaggactgctgatggagatgaaggtggcaagcaccacataattagagcaactgtaaaagatggaaaactgttcatttgcaaggctcaagctggagacaagaggtggtttaagggagcaagaagatttgtggagagtgcagcaagttctttcagtgttgcttaaaaaacttcaatagcattttatatatatatgctgtgtgtaaatcaaccttttaagtgctatctattgtttgaagttgtctaacctcccttttgtccacgagtttcataattttaagagacttggttggattaagtatctgaatacttaatgtctccttcgttaagctgctacaaggagtatgcattttcgtaacaaggcttaaatttttattcgagaaacaattatctcaaggaaattaaaaagtgtgaaatgttgattttgaaacgtagttatttgaaagagaccaaagaaaagaaataagcatgaagaacaattaatggagtcttctaacccaggactgcataggacaaaacagaaattgataatttataaggacaaaacttagcgcagtttcttaagggttggagatgctgttttccattcagaattggcgttttacattagtaatctgcattaaattaaagatcaatgtagattactaaggtgaaactcaaataccaatgaactgcattgtgttttgatcattccaatatcatgattaataggaaccaggtttgatcattagtctgtctatggcatggtctaatggtttgattattgggagccactgagccagtttcgagacaaggcaatagctaaacgtagcctgcaaaccataaaagttgtagtctcttatccagaaaataaaaagaagtgaacatatatcaatgatgtccataaaatttaataaatttgttttacagaagaatattaaatatatctaaatataatcaattaaaataattaaaattcaataacaattcgggttactaatttcaattattgtgattccagttaactataaagtgagaaatttttaaatagaggaacaatagtttattatcttcacaatagaagaaataatagtgttttaaattattattatcctcaagaaagtggaaataatttattatccccacaaaatcggagatgagaggtgcaagatagttcaaatctaatacataaatttttatgattgtacttatttatcataaaaagtgaaaaatatttatattctataattaaagtaaatatatataggatccaattcatttggttcaacaggtacatgatgcataaattattataaaattttcatattgtctttgattcgtacgataaaaaaaatacatgtatatcaagtgatcttaataaaatcttaaaaatttgtttaccgaaaaatattaaatatatctaaatataacaattgttagtagaataaatctagacacacaaaaaatctagatcccttattaatgatcacactggagtgtaaggaatttaaataaaggaacaacagagttgagaaaattatccaaaatttaaaatttaatacgagtgagtgaaatttaagaggtgcataaatgtgacaaaatgggcccaatctaaacagcctataaataaggccgggtcgggttcttaaatttagtccgaagagaattgagccaatttggcctaatttgacggattagatcaaataaatgaaatgtatgcttgagacctactgacttatttaatctgatatttttttcctttataaaagttatataaatcaatttcatgaaatgtgtgctgcaaagaaatcaatttcattggctaatgaatcccaacttacttactatttgtattgcatctaacctatctgcgcagttgttgtttttcttgtaaattatcagcagccgagtttatatgaactattgaggtaaaataagtcaaaaaactattgaggttatgctgattaatattgttattgtagagttatacactatattatagattaaaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcccatttccagctaagttttctcattgtttatacacagcaagaagattagattatgataagaaagtttaatgatcattaataatataaaatatttttatattattatttaattataatttattgttaacgatttttaaaacaattattataaaaaataataattatataatatataataaattatgattaaatattagtgttaaaaattatatatgcataaattaaaataataatttcaaatttattatctcttcattcactaatacatccaatataacaataattcaaattttttcttatctaaattattttaacaatatgtttttatctaaaaaatcataattcaaattcaagttatatcttaaaaacaaatagtatggttttttttaggctgagagtgtacaatcctttactcttattataatattgaaacgaagttatttgcgtgtgaaaagagaaccgagaagggaaacgcgtgatggtttaagaaacaaggaaggaaaaggcatataccaatcaccaaaccaaacgaaagtgtatctagcaaaggccaaagggtagtgattcacaccagacacaagggaaagctataaaagagaagactataaaaataagaaaaaaagaagagaaatccagtaaaatttaggtgtaaaacaaatgtattggtgccaattatttgccaattttataagttattcatttttgtaggataaatttggctaattatattccgctaaccaattttttttcttcattcacttgaactcgtatacacataatataaaataattatatattattatctaataataaatcatgattgatatgatatttgtgatgattatcatacaagtcataaccatattcattatagtaaaaaaaaaaacctaaatgaatacaaatattcgtagttataattaaaaaaatagtattatattatattttacgtatatatgttatcattctttgcagcacaagcagaaaaggagaaggtttgggattttagagcgtatgtggttttggttggtaactgaagagtgtgtggaagcagaagaagaaggaagaagaaggaatcggcggtgttaaactgacgatcgcatctcaaaggttggttacgatcgttgctttgcttgttcggtaagtcggtggatggatcatcgccgtctttatcttcttctccacttattggatctgccacttctgattccgattgttctatcttatcttatttctgttactgttccaattttctctgtttgtttcctcggaaaatgcatatataatttgtttattattatttatttatttattttgcaattttatctgctaggcgtcacgcaatctctcttgtttcgatagatggttataaatttggtagaaacattgtgctttcaagtaactaagcctggattcttgcatcttgcattattgttattatttttattgttgttgttgttgttgtttcaatttgaggaatctgtttgctgttttagcttctgttttgtcaggactcagtttcattgtacttactgttactgtttttgttttctatgcatacattttttttttttaatttgttgtttcaatttgtttgcttgtgttatttgttatgctaattaagtttgtgttagtttctatacagtgacagttttatttttctgtactgacattttctaagcttatgttaatttgttgattcaatttgaggaatttgtttgctgttttagattctgtttctcaggtcttggttttattgtacttactgttgttgtttgtgtttttctatgcagacatttttttcccttgtggttttttagaggcattttcttagttgtatggttgtttgtgttgttttctcgcttctgaaattatatatgggctaagggggcacttttcatgggaggtgtggaagatgaagaaccatccatgaaacgaatgaaattatcctctaaaggattagttggcttgtctaacggttcttctaaagagcctgttggaggcttgtccagtgacttgatggctcggcccctaccatccaaaggggacgaacatgttgttggttccaaaggggttataaagaaagaggaatttgtcaggataattgtaaaggcattatactctcttggttacggaaagagtggggcacatctagaggaggagtctggaatacctttacactcacctggggtaaatctgtttatgcaacaaattcttgatggaaattgggatgacagtgtagccacattgtataaaattggtctggcagatgaaagtatggtcaggtcagcctcattcttaatattggagcagaaattttttgagcttctaaatggtgaaaaggtcatggaagcgttgaagaccttaaggacagagattgctccactctgcattaatagtagtagaattcgagaactttcttcctgcttagtttcaccatctcctaggatagatattctaaggatgaggtctcgatcaaagcttctggaggaattgcagaaactgcttccccacacagtaatgatacctgaaaagaggttggagcatctagttgaacaagcccttatcttgcaacgagaggcatgcccatttcataattcattggataaggagatgtcattatattcagatcatcattgtggaaaagatcagataccttccagtacattacaggttagaaatgatgtgcctaatagatattgttgacttgttaattagtagtggtagtggaagcagcttcctcctttctgtttgcctattgcagactagaactctgttcgttagcttttcttttgcatttactttttcatgattataaagttatgtttactagatttgcgaatgctaaactgtggcatgttggaaatggatgtgaatatcatgtggtcattgttaaaatgcacttcctttcttgtaaatgagatttatgtatcattagttggattcaagggaggggaaatgagaaaaggtaaagaatttgtcttcagttccattgatccattcttttgctatttctttagaatgaccaccctgtctttactttctatagcatgagtcgtatctatattctgatgttattttctgattaatattgcaacagatattagaagcacatgatgatgaagtctggtttgtacaattttcgcataatgggaaatatttagcttcagcatcaaaagatcaaactgcaataatttgggaggtaatatttgatactgatctgagaatttacattttgtcttttctgttctctttcatattttttatatgaactgataaatgtggtttcattgcttgtgttttgattctgtcatcatactgccaatctatatcctagttgtaatgtattacttctgatacccacccacctaattgatcaagacacaagaattgcactctaacacacacacacacacactaataaaacatggcttaatgctatgaaattaggtctcactttttaaattttgtttgaataggttggcataaatggaaggctgtctgtaaagcatagattatctggtcaccagaagcctgtttcttctgtttcatggagtcctaatgaccaagagctcctcacatgtggagtggaggaggctattaggcgttgggatgtctctactggcaaatgcctccaaatttatgaaaaaactggtgctggtctagtctcctgttcatggtttccatgtgggaaatatatactttgtggcttaagtgacaagagcatttgcatgtgggaattagatgggaaagacgtggagtcttggaaaggacaaaaaacccttaagatatctgatttggaaataacagatgacggggaagagattctaagtatttgtaaagccaacgtggtactgttgttcaatagagaaacaaaggatgagagatttattgaagagtatgaaacaataacctcgttttctttatcaaatgataacaaattcttgttggttaatcttttgaaccaagaaattcatctatggaacattgaaggtgatcctaagcttgttggcaagtacaaaggtcataaacgcgcccggtttattatcaggtcttgctttggtggcctgaagcaagctttcattgctagtggaagtgaggattcacaggtatgagtcttcaatcatcattgatcaaaatgggaaaatattcatcaagtgtaatttttataatttgcaaattgaaagccttgatgtttgtatctctgttaaatgtttttattttttaaaagctgtctcaatatgttactttttcttcaaaataagttcaacatgcacttgatgcaggctatctatcgagggtcattaaaatattggcataaaagacacatgaaatggtgctttgtgctctgatggataaactggacatctttataaatattagttgaatgaattcaacttcaactattataatgttcaagaatcacgggcttctgtattatttattctaatttatcttggcttctgtattatttattctaatttatcttgataaaactaggagcatcttgattgataatgttagaattctgcttgatatgctctgtatttaaatctgttggagttcccttttgtattcttcttggccatcagtttgtcattataaccccaaagaaaatccacatttactagtttctagttgtggtgtttagtagattttccatgaggaatatagatacaagatgtatcttagattgatagaaatttagcaggtattaggtatatttatatctaatactaagccgggaaataaaaaaacgcagccgctaagcttctttcttttggatatgaaacaatacagcatgtaggacccttgtaatgttattggcattattaaccaaacttcttgtgatagtgaattctattggataattttggagaattattaaacttttattcggtatctttgtaggtttacatatggcacagaagctcaggggagctaatagaagcattggctggtcattcaggatctgttaattgtgtgagctggaatcctgcaaacccccacatgttagcctcagcaagtgatgaccgaacaattagggtatggggcctaaattgtctgcacaacaagtaccaaaatgttcacatcaatggcatccattactgcaatggaggaacttagtatgaccaactcattccaattgatttctcttttttcttatcattgcaattgtgtaaatactattactattatcgcaagtggaccattcatgtcaaacatgcatgtgacttttcatatatatctcataataaatccgtgttccattaacgtcaaactgcgatgcgagactttgtcttgttttaacaagtatcactgccatacgagggtttgctataataccttggtgaggatttctagacattggatggtggataaattcaactcaattgtttttgacagaaagaactccttatgattgagtttgggttctctgtttcccgagattcaaatttgagtttggggttgtaaatactaaatacctagcctcaaattggccattgttaatattagagttaggattttgttctcacactctcatttctcgtaataattgaaaatacaaattattataatgattaagtttgattcattataaatgaaaaagaaatgttgaaagatttttattttcttaaacaaatacacccaaattaatttcaattacttgaaacttgacataagttttagatttgcggagttctattagaaaaaaagtaaaaacactctcaggtaatgctaagagtaaatgtttttatctaatgtaactattagggctcgaaaatatatttaactaatttaaaatgagcatatgaagggaaaaagttaaagcttattattcaaatatgagcatgtgaagtgaaaaagtaaaaatatttattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcaaattttaaattagtcaatatcccttttttttagtcaaccaaggattaataaaaaaaaccattagaccctctcaacagagaaagtttgaaagatttttgtgcatttgaatgaactagggatgtttatagctttcatgaacatgtcataacaatttcttttggtaaacgaaggaaaagaaacaacaaaaagaaaattacactctaaggaaaatcagaagcaaaatatatgctaataagaaaccgtgtatttaaagtaaaaataacaagcatctacgatattataggaattttttttcttaatttaagtgaaaatataaaagtactactgctaaaaatttaaaattaaggaaagagaaaaattcttaaaaaatgaaaaaataaccacttgacatgtttgaaagttaacaactaattattttattttaatatcagatatttagtaaattagtagtgtctttcaaacacttaactcgtttatttccaataaaaaaaattaaaatagttgcaaaaagaacaaatacatatttttttatttataaatacatataaacaagaaggcatttacctagctttcaaaaagaaaaaaaaaggcatttacctaaaatggaaaacaaaaacagataaaatggaacagcggagaaagatacgatatacacgatgacggaaggaaagcacaagtactagctagggcttaactttttatttgtatggcggaaggtttttagtgtttttcttccaaagttaaatattgatccctggttattttttttataaccatattgtcaagtaatttctagaattttgccaattattaattttgatcaaagaaattaatttgatggagttcttccattctaattaaaattcgaatcgagaacttattaaaaaaatcagaatctaatattacttaaattaataatttgttgattgctaaattaaatattaatattaatctaaggagataatttattttcgataatcttatttcattcacccgaacctggttgcaatgcaaagccttataataatataagtgtataaggtttaaaaatttaacatttaacagagcaaagagcaaagacaaaagtagaatagcagtagctgcagctgcgcttgttgaatcaagttacccactggggatttgttcaatggaaacgacgaccaataggaacaatatagggaagaagaaaggagagccacttttccgtcaaaaccccaaagttgatgaagtcaccaggattcgcatttcccagattctagaacacttccgagcttccaatgatgaaggtatttcctcccccttttttcttcaccatttcatgcacaaaaaacacaactttctcgtcggaaggattatgatttttgcataactatatccattcatgaaatctgggttttgattatttagttatttatttgctgcagtgtacaagtttgatgctagtttgtccaaccaagagcgtgcttgggtgcatcaaatggccctcaaaatggggtttagatctagaagttatgggtgagtgttaagggcagcgcatgtaaatttgccacttttagttaaatctgtaagaattattattgtcaaaattcttaaatggaatagttagagatggaatgaatgcttcagatttgtgtaattgttgatattggacctgtgttttgtgtaggccagggaaggaaaggagagtgtgtgttgaaaaaatgaaaaggaaggttgacacggataacgggtttggaagtcttcctcctttcacattttctggagaggcaaagtgggtgttgggtgatttgtttgctcattatccacccggtgatggaaactcgtgggagatgatcggaaaaaatagtgacgacactactactgagggaacaaaacagaggccggatgatattttcagccggccctctatgtccaaagctgaaattgctaggagattggaagctcttgcttctagaatgaacaatgtctctaacttgaaacaggtcctccttctttctctctcctttcaactccagacatgtatgagttttgttggtgaacctacatatatgaattttgttgcttagagtttgcttcaaaataagggaactgaatattatttcactagcaataaaatggtgcaatggctagtaaatatatatatatatatatatatatatatatagacgaacaaattaggttgtgtcccatgctaatggctgatttattgtcacaaaatgttggagttacatattttatttggagttcatcaagtacaatttcaaccatgataactcacaaaccctttgtccatggcttagaattttgattttgcccctgcactcaaccttgcaactatatttttctttttttgcttctccatgtgaccaaattaccatccaagaacatgcaataccatgaggtggacctttttttttatcaatagtggatcctacgtaatctgcatttgtgcacacctccatggacaactttcccacttgtatgattaataggccactcttgaactattcttcaaatactatagaatttcattcattgtctataaatgtttctcatgaagatccatagttatcaatcttggatagcgacatgtagtgcttgtttgctatgtgtatggcaaatcatttgtctgtgcaaagaatgaaagcaatttgttaatcctgctacacatcagaatgatgttttcttattcttcctcttctgccatatatatagaattttcaaaagaatagtcttgttattgaattatttgtctgatttccattctcgcagatcattgaagggagatctaagcttccaattgcgtctttcaaggattcaattacatcaactgttgaatctcaccaggttaatttaaaattgcctttggatatgcatctacttggtagcttgggtgctgatggttgcattataattaagcttatatgattcacattgacatgctaaatatatcaaataacatagttgagtaagattttagttttagtgcatttcaacatgacaattaaattggatttgcagattaaatttttgcatgtgttttggtcttaatattcctttcacgtgtttcaaagcaggttgttctcatatctggtgagactggttgtggaaagactacgcaggttactaattctttgttttgtctttagtatggtacagctacatttacatataatttgtttgtgactgtttcaagatgatcatttttaggttgtatgttgatatttttataattggtccatttagtatgtatgcttgtgatatgactctgcacccgtatttaatttttgtattagtgcacttgctctttttacccttaatataaaataattggctcaagctttgatgattgtggacactgataattttttgatgctttgtgattttgggtttcacccatctgtatttccatcattgtatatggaccaaggtcttttagtaatctttctatgctatgcaaaacacttatctttctcttttttttattgtcctgtttaactttatattaaacatgattcaggtcccacaatttattttggatcatatgtggggtaagggagaggtatgtaaaatactttgcactcagcctcggcggatctctgcaacttcaggtgtgtgactctttcggacttaaatttcaatgttccttttttagtcttaattgaaatgtgtttctttcaatgttccttttttagttttaatggaaaattgtttccttctgccatttctatgtttagtttccgagagaatcgctagtgagagaggagagactattggagaaaatgtgggatataaggtaattttgtttatgtacttttggtgtagtaatggtactctgatcctttatttgaatttattttgtatagaaatatttatttgaacattgagcattgttatcataatcagactagttttttgcattcgtgtgttacactctcataacacaccatgtttttattgataccgaggaggaaatctataagatgtcattagtaacgaagaagcatgatttttctcagcatgatttttctcctgtcattgcttcaatctacaaatatcttttctattttcccatatcactttctttcttacatagaattatgactttttgcccttcaacattcaatatcctatgttgattatgccagtcctttcctaagcactggtttccttgcttcttatagtagcacattgctagttttcctagtggtttacatctcatgaacatataattctgtggcttacattttaaacaaaaaatccagatacgattagaaagcagaggtggaaggcaatcgtcaattgtgctatgtaccactggagtggtattaagggcgcttgtttccaaaggttatcattcgtcaaagatagggcgtgtgaaggatgatatttctggcatcactcacataattatggtacttgtaaattatttttttatctttagctagagcataaactatggtacttaatctttggtaaatacttcttctataccttattcttttgagttatttggatggttaaaaaattggttatattaggtatgactggtaagttctcagataaagtggttaattgaaaattcaaattgactaggaaaatctgttagaatccgagacatttttttttgaaattgttgtaaaattaggagctgtttggtttcagaaaatattttttgttttttacttttaattacaaaattggcacttgttttactttgtttcctattttcaaaagtttgtagaggaagctatgaaaacagaaaataatatttggttttcagatgggtctctcctgcaataggtatttgtaatactttgaggggaagtatactttgaaactttcatatagattattatcttagagactttgttgtgataagtgagaagtgaattcaaatgtcttcatatattccctcttcatgaatcttggcatatgaggcatttcctgcatatactttccttggaaagtatgccttggcattgcgaagcatatcctgtgcatcctttcctcggaaactatgcattgcaaactaaggtgacattcaatttttgttcaggatgaaattcatgaaagggatcgatactcagacttcatgttggcaatcatcaggtataccattgaaaagaacctattggcctttattctatagtgtggtatatttaaatacaaatgtataaatgcttgttgcataagtgaggagaacattgtgctgtaggttaagcttgttcgagatattttgcacctattagctttttgggtagagttgagtcgttccttgatgagtgcaaatgccttttttttaaccacaagtatgtggaaataacttcctgatatatttagtcctccctcccaaagaagaaagattatacataagttactggcataagaggtttgtctggtttttggactaatctctaatttttggtaatttatatgcagagacatgctccctttatatcctcacctacgtctggtcagttcaatcttattacatttatatccttttgtctctatttctctgtctcctgtcaagtgcttatttaatttataattatgttatttcccatttttaaccttctggtgctctaatattacagatattaatgagtgctaccattgatgctgctagattttctcaatattttgggggctgcccaatcatccatgttccaggcttcacttatccggtacctatatagtcgtagattgtaaattaactaatactttatcacatattacttactacaattgtctatccaacctttcttcaggtcaaaactttctatttggaggatgttctttctattgtaaaatcgaggcatgataataatcttgatagtaccacatttagtattccaaaaaacacttgtgagctaagtgaagaagagaagctttccattgatgaagctattagtttggcttggtctaatgatcagtgggacctgctgttagaattggtttcttctgaaggaaccccagaactatttaattaccaacattctttaactggtcttactccgttaatggtgtttgctggaaaaggtagagtgggtgatatgtgcatgctcttatcttgtggggcagattgctgtttaagggacaaagatggaatgactgcattggagatcactgaaagggaaaaccaaccagaagcagctgaaatattgaagaagcacatgtataatgatttttccaactccatggaagagaagaagttacttgataaatacctggcaacagtcaaccctgaacttgttgatgatgttttgatagagcagctgataagaaaaatatgtattgattcaacagatggagggatccttgtttttcttccaggctgggatgatataaatagaacacgtgagagattgcttgcatcatcttttttcaagaattcctcaatgtttatgctcatacctctgcattcaatggttccaagcatggaacaaaagaaggtttttaggcgcccacctcatggttgtcgcaaaattgtactatcaaccaatattgctgaaacagccatcaccattgatgatatagtgtatgtcatagacaccggacgaatgaaggaaaaaagttatgatgcttataacaatgtgtcaactcttcagtcatcttggatttcaaaagcaagtgctaagcagcgagagggacgtgctggccgttgtcaacctggaatatgctatcatctatattcaagaactcgagcagcttccttgccagattttcagattccggaaattaggagaatgcctattgaggagctttgtctgcaggtattcgatcttccctgattggtgactcagaatcttggtgctttttatatactcaatgttaaaatagtaaaaaagttctctggtatcccattagagtgtcaatattaaaagttagaaaatggcaaaagttagtaactttgcaatgctatattcaaacttataatttttcatgatctaatttgcgcaatgctgtgtaatgtagttggttattggtttgtgcaaaggaaacaactttcttgtcaggttttgggaagagcaaaggtccttgtggggggttacaagcagggtttcaatggactgattctatatgataatgaaacaagacaataattttcccctcatgctagatttggttcttactctctctctctctctctctcttgtgacaggtaaagttgcatgatccaagttgcaaagtagaagaatttctacgcaagacattagatcctccagattttgagtccatacgcaatgcaattatagttcttcaagatattggggcattttcaaatgatgaaaaactcacccaactaggggagaagcttggttcacttcctgttcacccattaatatgcaggatgcttttttttgctatattgatgaactgccttgatccagctttaactcttgcatgcgcatctgattatagagatccatttacacttccaatgttacctgaagaaaagaagagagcttcagctgccaaatatgagcttgcttctttatatgggggttgtagtgatcagtttgccgtattggctgcatttgaatgctggaataatgcaaagcaaatgggtctagaagcacggttttgttctcagtattttgtgtcttcaagcaccatgaatatgttatcaggcatgcgcaggcaactccaagcagaactaattcgacttgggtttattcatgaagatgtttcaggttacagtgtgaatacacatgaccctggtgtgctccatgcagttttggtagcaggtttgtatccaagggttgggagatttcttacaaataaaagtggaaatagggttattgttgaaacaacaagtggagataaagttcgcctgcacaatcattccataaattttaagttgtcattcaagaaaaatttagataacactttaattgtgtatgatgagattactcgcggtgatgggggtatgaacctaaggaactgcacagttgttggaccacttccacttttgctgctttcaacagagattgctgttgcccaagcagaagaaaatgatgagggggatgaggatgatgcaggaggtagtgaagatgaagctggaagtgaagatgggatggagtttgatgctgagtccagtggaggtcgtgaggataagttgatgtcttctcctgatagtatggttaaagtaatcatggaccgttggctttattttcgttcaacagcaattgatgttgctcagatatactgcttgagagagagattatcagcagcgattttatacaaagtaaataaccaaattttacttgtttagtttttcttgtacttttcacttttgtgatttatccatgtcattcctgttatgatattcttgacacattggtttttacatttttaggtaacacatccaaggaatacacttcctcccatcatggcggcatctgtgcatgctatagcttgtattctgtcttgtgatgggtgcattggtgtgcccgcaatgttagaaggtgtggacacactaaccactatggtcaatgcaacaactttaggcaagccagcaacaggtactaggcgttttggtaagagaccaaaaggatcccttgcagagcttttaaatcacgatgggcgccagacctctgggccttattttaaagcataggaagttcatcaagtgggatcaaccccaaacctgatcctgctttctcacgataatggtccaaacggaaggttgatgattgtatgttcagttttgaaagaagcttatatagaatacaaatcctaacagtgaaagtgaaacttgcgttcagctcatatagagaacaaatcctgacagtgaaaaattcagtcagaagattgcctttttgttccttgtgcaaacaatgccttctttttcttggtcggcagatgcgtttgtgccacaactttcaggtgtgtgcgcagtgagatgagatgatggattctggacattagttccctcgcttgtacaaccacatagtaaaatctttgtaaattctagtgtgaacgtttaatatgaagagtagatgtagaatagttaatgaaatcttttatattataaaatcaaaagaggaatgaaatctctgtgctgtgggctttgagttgatcatgatataatatttagagcgtcagcgataaacatgagatttatgagcatctttcttcatgtaacaagtcaagatttttattctggaaaaattgccctgctagtcagcctgacagacctaaaatctaaatttatatactttccacattggaactttggaaatatgtcagtttttgaacaacggaccgtgttaatgtctccacaaaaaataagcaaatatgaaaatgatggtcaatcgcatccctggatatttgatccattgatcaccgctgttacgtctttcaattagcctcaaaacaaagtttgatgtccccactgttgaggacatccaatgctttcctatgagcactctgcaccaagattataaatcaaacaaaaaggttatatcagcaacaacacagaaagtgatatcagtacactgctaattattaccagaattattatttaaaaaaaatgatctgttatatgtggaatgcactgaactgagaattttaagacagaatagtcgaaagaattatttcagttaaaaacaaaactggagaaagtgatgagttaagatgtctataatgccaatggaacagaccaaaatagaataaaaagaacatcagagagacaggaagctgagatatcataccagcaccattacattgtcattttataaatgcccagatgctgaaacctaactatttaggcaattaccatataaattttcaggaaaaaagaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacataaaaatatatgacctaccaccattcacaacagaaaggtgatgaaatcatagcaaaacctaaagttatggacattgcttgtgcctcctcatcataaattctcaaaacatgacttgaatccccattctgcaacgtgcaaattagcaaagtcagatatgcagcgaagccaaagaaacagtgaataactaaaccagaataagacagccagcaattacacacagctcgccccagaagttccgctctttctttcacttccatcatccgcttctgattcctcaagttatgtttatccaaactttctctcaacgattcatcctcttcagctatctgttccctttttctgctcaacataaagcaacacaagctgaatatcctagcgactaaaacaaatgaatggcacaaacagcaactgcatctgaatgttgctaccaaacattgacattacatatcatattcaataagtttaattgcacttttgatcttcctacttttttcaatttcgcaaatttcgtgtctccattttttttttacaaatctgatcctcactatttaattgtgcaattttggttcattccttcgcttaacatcttatatttaacagcaataccaaatgtcagtgtagcaaagtgtctggttagcatttttttttgttaaaagtgccattaactctgtaaaatattatcaatccctctaattccaatgtctgaaaaccttagcacttcaattcacataacaaaacttacgaactagcaattctcctaaccagtgcatgtgaatagacgcgcattccctcggttcaattcgaagcaccacggcgtcgtaattattaacatgcaagatattttagaaacggaatttcgagtggtgaatttgataatgttgattattaaactcttccagagatcgcgttgagatttggcagcgatggagccgcagaggtgatccatctgaacgcagagggattggatccgagtgatgtcgttgttgacggcgaacgacaggtcggaggaggactgctccgactgctccacgcgctcgaggccgtcgcgtatcttcagcaaaagcttcttcgcgctttggtaaatctccgataacgttcctccggctccttgcatggcggtaacagagaaacaaatcgaaacactcactcttaacctcaatttcgaacacgtaaaggttttcaaaaaaaaaaaaaaacaaaacggggcaacccggaatgtaaccgggttcggatacgggtcaagttatcaaggaaaaagaacaggaggaatggaggattaaaattcggacttattttagataggataataaaatatgtttatagtcattctaaagttctctaaatttttaatattttttgacgttaaagttctctaaatttagttttagattttttataaaaaaattattctattttattttttaatttaaaaatatatcattttgatttttgaagtggttataattaatttttttaaatgtattttgaaacctaaaaattaattatttataaattaaaaagaaggaaatatgaaaaaaaattatataaaaaataaaactgaatttataaaattttagaaggataaaaacgtattttaagttagagatataaatactgaattaggtcaggattttctgtccacactattctacccgtataaaaaagagatttttatagcaccgtgtaaatataatgttaattaaaaaaatttataaattttttatttcttaactcattgaaacactttttaaagacaacaccacaaggttcataaagtataaagcaatatttcaatacaataattctaataatacaacaaataaagttgaaatttggaatatttaattattaatattattaactgttaatttttttataatgaatgataaattttattatttaatagtatagttttttaatttacaccatcatttaatcataaatattaatttataaattataaatttattaacttttataataattacattaaaaattaaattaaaaataatttttgttggattgataacataaaaaatttacatgatacctgcctagctattaaaaaaattaaattttatttttaattattggtcaaggattagtaaaagtaaaaccaattaattgaaaaaaaaaaatagatgcatgcgcagtcgtatttaaaagaacataagacaaacaagcaacatagaacaaacaacaccaactcccccattggcatgcagtgttcttggagctgaagaaagttccagaacacaaatcaacgacgtgcttgatattggtgcaagatgttattgtcttgtttagggttttaaatagatataaacaaaaatagtttattgccatgaatatcaaaacacgagtcaacaagaagctttgcataaaatgaaaccttcttaccccaaacaaaaatagaagacgcggatagtttgaaactattcataaggacccaatactccacctaatcattcttgaatctacatttttaattgaagattggattcaactttaccatatcagttggtgtgaaaaatacttgataagaatgaagagtgcaattttgataatatcatttaggaaccgtctttgaaaaagaatcgtatttgaaagttgaaaagaaccgtatttgaaaaagaaccgtatcagttgtatgagtaaaagaaccgtatttgaaaaagcttatttatagtagtgctaacattgggacaacgtaagccgtgaacaacagccatagcctttatgtttgttttaccactataaattaatacttatataaattaatacttaatgcatgaattaatattgtgattaattgtttttcttttcttgtgcatactttttttggtatgtttgttataaaagtagaaagaaaatgaaaggaagacgaaattcatctatgcaagtttggcagtttagtaatatattgaagaatttgtgatgatacaataggttattccccccttttgattattttgatggagagacaagttaaggaaagcatggtacgtaatccccacgccaagcagcatcacatatttccatttggggaataaaatgatgtaccttttgatttgagatgtgtttgtgtattataagtggatgcaaaaaacataaaaaggtacgtaagagaaaaataattataattaatatatgtggtatatatgacatatacgtcaatttttagatgctcaaataatataactcttctcgccttttcattgtttttaataaaatcaaacaaaggaggataaaaataaactcttataacatgaatttgtgtctacgaaattaaaacattttttttctaatttctattaattaaatttaaataatgatgtgttttttttaatattctgtggcacgtgttttaaaaaattgatctatattaaatcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctaacaaatatcatctttttaaaacacattccatcttttgtatactgtcaattttaaatggaattaatgatcgattggaggacaaaagcgattttttctttgaaaaatagacaaaaagaatttatgtgcaatatacgcttcagcttttaagaatccattatttaattcaatttcttgaaaagtcattggccttggacttttggaggttgctgcagcattcatattgaaatactgtatataggtgagaccagtcttattattcgcgatgaggttcactatagctatacatatatatcacatatgtaaccgtgtgaagcacagaaaaatgataaaaaactctgagagaagcagtgtaagaaaatacaacaaatctgaacttccacgcctgcggtggacacctgaacttcatcaacactttgttgaagctattgaaagtctaggtggaaaacaaagtaagtttaatttccttcatgtaaacaaatatataagatatttataattctagctagggtttatagcaaattatatgtagagtatattaagcatatcccaaaatcagttaatgaaagcatatgttattggatacaaaagtccgtttgatcgaaggaggccagtaatgttgatgatttcgatcaaattctttcattttgatttcttctgatccaaccttagaattgtccttgactccttaactgctttgttgactgacaattttttgcatgtctgagtttcatttctagatttctttgagtttgcttttctaattcttatagcataccacagtatctgagaagagaaaaattaatttgtgtttgcaatataatttataatagcacatatatatgacatgtatacatgggcggatctagcttatgagttgggggcagtgtccctccttaaatttttcaataaattttaatatattcttaatacttatttgcagtgcttattaattatttttagtacttgttatatagtttgcagtacttgttaattatttttatttgtaattcatgcattaacacttgtttataaattgattaaaattcttactcttcattgaaatgagaaatacacagtttaaccatatgcattttgtagaaatattttagtctatattgtaacagctgtttaaagatctcaaactcaatacttatatctaaactaactctcaatgttgtcatcatggtcttttgaaatctcatcgtaaattataataagcttttttcattattttattcaatccagaacagtaatttggtctgactatttgtttgtttctttagatttctgtttataattgtttgttcctttaattttttttcttaaaaaatttcggggacgctgtctttgaacccgacactaattatacagacataaataaatttttttagatctgtcactagtgcctcccttgtttctggatctgccactgtatctgtatatcagaaaattattggttcataatatatatccatagatgaagcatgcgttcgtttcctctctttcttctctagcttttttgtgtgtgtttgaaataacaaatcaaattaaggtgggaaggaaaggaactgtttgtggattgggatgcttaattaagctgcaaatatataaatccagcaaaatggttttgcagaggcaactccaaagcgaattttgcagcagatacgtgtgaaaggactgagaatcgctcacatcaaaagccatcttcaggtatgcatgtaagcatatatatatatatatatatatatatcttactcgtgtggtccaaatcttattattattttttgtgaatggaaaatatacgtatagtagctaatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgatgatcgatcaagttgagttggagcaactttctacttatgattgatcacttgcatatagtttaatgaaaatatcatattaattatgcatcttttcagattcaatcacattatgcatctttactgtaaacaactcagcaccatcatgatcatatgaatcaccattcacacatgtcttattcttaaagaaaacagcataattcttttctaggagttatcacacgcagattgtggtcaatttcaatcctacctagacaacacatttgaaattaatgatactttgaccaagtatcaattgtagcaactcctttacctttttaccttatcaataaagcctccgtttgcaattttaattataatttcttttaactaattatccagatctctaaattaattatatgccttcatggaaggtcatgtgatgagtataatcaccatcaatcaaaactccgtgcttattattggctagctatagaacaaccaattccacaagcaaaggattttctttttgttgtgctatggggttagattagttgataaagtggaacgttgtattctcttgttcaataatttccaaatagaatcaagataaacttccatcgatcgatctagctataataacccacatacacatgataatgttattctcattttataaaatatcagaaattgtaaaagcttaaaatcattttgaacaaattataaatttgtgataagtacatttttccatggaaaagaaagataattagttagcaagctggacgaagtccagtcgtctccacactctccagtactttatctggtttgtgattatacttaaacgataaatgttattatctatatatgtatagtcatattcgacttgagcatgtgatctctacaaaaaaagaggctacacatggtctttgtagcctcttttcaacccaaatctgatatccccaatgttgatcttatatctttgtagagccatagcaaccaaaaactcggttaattatcagagtgatctttgatgatacctcccataccaatgaaaccagttgaaaggcaaagtgattatttttatgtcttaacatttcaaaaatattctagcttgtatatatgttgaacacgtgcaggaaaaaaaaagtgtataacgatcctttgaattgcatactgtttgaactttgtctccatttaatcaatgttaaattgtttaaccatacatttataacatgattcaacccatcacatttaactagtaatttcagtgtgtgaatggtacaagataataatcaaaattaatactacttaaatattttttaatatataaattatattttaagtttataataaatgatttaaatttaaatttaaatataaaattatattacattattgacaatttctaaaaaattaattttggaatgaaaataaaagaaaatagattgaaaatgatagatagttaaaaaattaagtatgcaaataaaaataaaaagaaaggacgtttaagataatggagagaaatttttgagtaattatagagataataagtgaaatacacttttttaattgtgtattttaatttataatataaaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagttttgcatatatacaactattttttcataatcagatatgttttgtttatactaaccacgtggtatgggttatttctaaagccggttatatatgcataactgatatcatcttatattttagatttagatttaactaaacactacaaactaactcagaatgaaatttgtcgtccaatttgtattttggcactttcttggatagatgagaggcacgaatttttctcaataatatgcatacaatgaatttttgttaaaaagaaaatttgcaacacgtgatgaataagaaacggtcaattttacatatttaactatataaaaacagtttgtaatatcacatgcaacatatgagtaggcatactcctatgtcttaacaataataattatcataatcacaattatattttatttattccctaatacacgtgattccttgatttttctacggtaatactcagagatgagcccaaagcagaatgttaagtgtctctcgactccaggaatgcatgccagtttctcccatatatagaagtagaacatacagtgacatttttttacctttctgcggatattcatgttctctgtgatctttatttataatcttcgtcgtcggggttcagatcctctgcgtggtttttacttaagttgttttcattatttctacgttgtacgtgagtttgtacaatatatttaacataattaaaatatatatataaaaagtggaagaacttatcatatgaaaataattatcttatctgataaaaataattaatataaattgttagattaaaataaaagtttaaaattaaaacatcataaattaaaattaaaattttatttaagtatataatctttataaaatttacccaataaaaaataaaatattttgaggtaaattaagcctttaatatatttgattttctttttgataaatattataaagattttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatgtccatgtagtttatattccatgcgttgcacttacaaaatttcaaattaagaacttagcttacttcaaattgttagatggggcaggtggaatggtgtttgcttggcacataaaattttagtcccaattaacttagaaaataaagactaactttaatttatatgtttttttcccaacaaaatgcttttttatatgtttatttcagacataagaaagtaaatattgaatacagcgttttaaatttaacatatcgatcaaagcggaaaatacgctttgtatacaaatattgcatgatctaactaattacattctttattcttgattaaataaacgaatttgaatacagcgtattaaatttaacatttttattaaaaaagaagaagagagaagaatataaatgttcattacatgttattcacagatatattttttgttcaaaatatatattctggaaccttgcaggaatcacagtcaagtggactcttgcttagtgatgatgtgtcaaatgaagaagaaaattttgctgatctatctttctcctttagcacgcctctgatgtccattattcaaagtgagaatagcaaagagataatgcgtttttcgtcatcaaatgcagctgctaatcattccgttgattctatttctacgccgtcttttgcaaacaattacataaacttagacctaacaatctgaatatgtgtattaattctttttatttacttacacgtgcgtaacactagttttaattacatgttaactttttaggcaaggacttacaattaatagttagttaattattgtattctttattacagtgttaggcttgttaggcgtaataaaaggttctctttctttttctataacaataatgatacaagaatttaaaccatgcttattaattaatggaaattaaaatctaacggtgatgatcgatcaagttgagttggagcaactttctacttatgattgatcacttgcatatagtttaatgaaaatatcatattaattatgcatcttttcagattcaatcacattatgcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaaaaaaaaacattttattgctccttagaaaaacaatcgaacgtcttcctgctcctaaatcctaattacgctagatattataattatccattcgtcccctataggctaaactttactcaccttaaaaaagtaatcttttttgataaaatcgatggattaggattaaatttttttccttaagagggagaaagaggccacgtgtacttatttggatatttattatccatcattgcatggtacatttgctagttgctaccacatataatacttcatttcctcggcaaaccagaaattaaataccgtggtgtcgatgatcttgttatatatcacatgaagatttaccaaaaattcccgaatcctatgataatttctcctgccaaacaaatggaacgaaatactttaaaattaaactaataaatgtacattaataggaagaaaaaaaaggcagaatgaacatctttgtacaagttcggatccacagggaatccaaacactatcaattgtttctgttctgttacatctttcactacacatcattgacccgtatatcatttttctaaaataatatcactgagcagaattttcactgcctcttcgccaacgtcttccgcaaccctttgataatttttgaaaaccaaatcaagttcataactgatagcgccagcggcacaacaataactaacacttgtccaaacgcgtgcatctgctcaatctgttgaatgaataattgaacaatgacgtgagatcctaagctttataaagtagactttgcttgaccagaaattagaaagaaataaaccatttttaagactcccatgcaagactaaagtcttaaaacatttattacaaaatgaagacattacacattctccttgatgcacgtaaaatgcaacagtcgttattaacaactctcatacctcacaataaaccactccctatccctatcaccatgggcggatccagaaaaaaaattaagggggaacactagtggcgggggttcgggagtagctcccccgaaattattttttttaaggaacaaaccattgtaataagagtgtgaaaaatggtaccattcaaaaaggaaaaaaaatgataaaattagcgtgtgaccaatgcttaaaaataacaaaagtgtgaccactgcattcatgaaattacaaacatacaaaaccatactcactcctctcctatttttcatcttttttattattcttttttcatacttttcgttttcccctagtataaacatctaaactattttttattttactttattttattattataaaaaattacccaaaaaataacatttttaaatgtagatccgcctctgcctaagtaaacactggacttcttgaaaatttaagggggggcactgccccctcaatccaatacatccatccgcccctgcctatcacatccaggtgtatttttaacaattttctgggatgaatatttcatgactaactagttgacatgatagatctactatgacaacatttggctaagcaaacaaggagtcaaattgtaaatttattggaacaagttctaccaattcagtcttattatgtagaggtaatggtatgtaagtatatacaagcgtaaatggacagagactaccacactaaggatgagtttggttgtgtggaatggaagggaaggggagaattgagaagaaatatttaaattaaagtagtgtagaaaaggtgtgggacccacacaaaattttaaaaatttcttcacaatttgaacataaccaaaccaagggaattgctgatccatgcacccaaacacacatacatgcaagttcaaaaagtgatcttgttggcaacaaatacatccaatagaagggcaacaaaacattattagccatcttaaaaggccaaaaattcaatattaagatctgcttgctgcaaagcaccacataccagacaattcttaaattcagtcagtagttattacctggtcaaagtgcaggtagacatggtaacacatgtaaacaaacaaaagtattctggcaacctgcaggaagaccatttcagttagcatgtccaagatggcacagatgagattgctatatacttaatatgatatgcaattcacaatgattccacaaataacaccataaatgagtgacaatatatttcaaactgcaatgacttgacccaccagccaagcaatgaatatgacaaccccattgatgagataagcttttgacttcttcattccagctgcatcaagataccttcacaaacacagtatgtgcattagtaaataaattacatgacatatagagtgcatatttaggtgcaagattaccatctcaagttgatcccaggagttgttgtctcagagatcaggaccatgtatgtgtatagctgaccctccccgctcaacattgaaaacgctactgctactaaagaaagcaaatgatgaatcacctgaatcaatgttaatattaagtcatgttaaattcatatttacaaccaaatagggtgaaaaaggaaggaaaccaaactcttgccataatcaagtggaatatcttaaaattgaataagagagttcagatgatcaaggttagattggtttaaactatgcaagtcaaaagatatgatccttacatactcatatccaccaagagaaggaaaaaaccaaaatatcatcccaaggtcagcgatgaagtaaccgacagacacctgtcacattaaaaattaaaacataatacaaatttcatgaccagataaaaacaaaaatgtgttgcagctcataatatgatgatctataaacgtaagatatatactttttgttatcattggatgtatcagtaaaatcaagggaataacaagtccaaatttgttgtaaatcatgactagcaaaatatagaagaactactaaaaggaaattagcagaagatatagatactaagaaaaatgagaagagtgatttagttaatatattatgccgatattatttgttaacatgctcagacaatatggctacacacacataaagaaatgatgataaattggtaacatttcagtctaacttattcaatctagggtccaaccaatgccaattgcattaatcacacactctggatcaacatatggttcacgctaataaaaaattgtcatttatgtactttaattatcaaatagattacattactctaggaagtatgcaggtctgaagagcaattgcagaacgctttaaagttaaaaaagtggacaatgtaaaacatatgggaatctatttatcttgcttttctttcttaagcaaatctttcagaagaaaaaacaaattatgaaaatcaagcagcaagttaaatgcagctgaaggcaaatagcatttcatcactagtatcctactgatctagtcttgggtgtttgcattgatcattatacaaaaaaccttcctagtagtggcttcttctaagaaacattcgtaataccttaaatctccaagctggattccattcatggactacaaaagacaatgctctacttcatggaagttaacattacctacttgcttatcgtatatacttactcatcaacaattttcataaaatattttttttcttttacccaggcagcctatgatttcatctaggtctgtcttgctttcataacaaggcatgggtgttctccaaatttaacttccagtatatctagggattcagactcaacttacaatatctccatcataaaaatgtcaaaccatgaaaagcccaccaaaatctccaaaataaatcttatgtatattatctcatactttttgaactccactacatcatggcattcacgacaatatcagaaaatatatatggcaaaaagtcagtgatcaagatgatgctaataatatctaaccccacttggcagaatcatagattaaaataaaaatgaactccatgatccatcccttcattctattggttaggtgactagatttattgacatgtcctccgcagtgaagtgagacaattatttgtgattattcattattgtttatcataatggtgacctgcagagataaatcacaaagaggaagagaaaagggaaacaaactgtaaagagtccacatcattcttacccccagagcaaaggtagatgatgaagagcttcgaaatgtaataagttcggacgactggttgtcagaatatagatttgagcaaaacaccaagtacaacgacatagttgttatgaaaatagcatgaattgttgacatagaactgcacaaataataggggaaaaaatgtaaacatattatcttgttagaaacaaattaagaaacattccaccaaatgaaaacatcccctcaccgattattccactcaacacgttggattctagtgaggctggaatagctcttaaagtgaacagtgctaaaaagctgagtaagatcatagacctggaaaaacagtaaatatttagagataattgtaaaataaaaataataaatagcagtaatcttaaaagctcctaagtcaggtgaaatactttagaaaatagaatgaggataaaatttaatacaacacaccatcttgcaagcaaaaataccaccaataatagaagtatatggaatcagagggtctgctaataaatattccttcacgaacaaattagcccggttctggtaggatttgaatttcatcatttctttagaagctaacattgcaacaccaccccttgaatgagaaatcctttgaagattttacaacctttctgcctttacacttgtctcctgttatatgaataaatacaagtttgaagacaagatattcaaaaactaaaagccaaagatgaatccttatttggtttctctatgaaaatgactcatgagttaaggataacaataattatcaaagaagttacattaattgagggaaagagacttaatatattaagtatatgtctattgtgtgccaaagagacaaggacatcagataattaatcaaaactttcttatggagaagccaggatgctcatatataaggaaagaagaaatacaaggaatttggaggatagggtatcctccttgcagaaaaggatagtccacatccaaaattaaataaatctgctaatatctctcattcaaagcaatcttatgccaaatcatgtctaaaaaggtaagaacatccaacagaaaattcaaacattcagcattcaacaaagacaccaaaaattttgttcgcatacaagtcgaattgccataacactcttcctctttactccatccaaaacctctgaaataaatcaacaagacaagaaatgcttcatattctgtgcacatgcatacccaagtttcacccaaaggtcgattccaacttccaaatgttgctatccagcaatgttaataacaactaacaacactaccgcagatccaccaaccaaaccaaacatatgctaaattcaattattaatacttacaggaaataaattatcaatccggagagggtaagagaaaaatgatataccaattcgctttagacctaaatatcagtaataaaaaatttatccattaatatcaagcctaaccagttaccactccagaaaatcaaataagttactactaagattaatgtgaagctgacaaaagacagtaaaaaataataaaaaaatgggggaaaatcttaaatcatttaagaattgaagttcaccaaatgcaattcaaatagggctctaattttccacaccaaaccagcacccaaccaagttcatataatcgcaaccacttgacttgatcaagtgggattgaaatccttgcggatcttcaaagcaccaactatttgtacttctcccacacagagaactcattggcgtaagttcagggacagcaacaaacaaacaaacaaaaaaattacaccaaatttcagagagtaaaatctcttcacgaactaaaaaaaaaaaaaaaacgaatcgttaaagctttagcagcactcgagacaaaaaggaacgaagtgaagtaccgaggaagggcgaaaaggcgtgagtttggcgaagggaagaaatgcgatcggttgggtggtgagagcgtttgtaaggaaatttggagttgaaagtggtgaaggtggtgggatcatgctgcatgagttatgttgattgaagaaatgggaaggggaaatttgaacactgaaaaccctaacatgttttgattggattgggattgggattggaagaggtgaggctaaggaggaagatggcagataggaagaaatatggttggcaccccgcgtcgtttatacactttctcaattcttcttccttttttttttttaaataaataaaaaatgaaaaagaaaaattgttccactcccactcgtagctaactcagtattcaatcgctttcttcaatcatttcaattattacgtgtcaaatatggagtagatcttttttaaattaaattaaatctatctcatttattgtgttgggtactgggttccaatttcatgtttctagcttgtttttaacggtgatgtataaaattaagtcacgtatcaggaatttaattaacttaataaaataaaatgcatgaattatattataacttttttactactctttattattcttacggataaaaaaatttataaatcgttattaatatgagttttagttcaccaaaatgatgatgatgataattactttatattagtgtataatttattttttcttctagtaatttttgataaataaaaatgtttttgaaattctgaaaattcgataattggctgattatttatttaatgaataaaatgttaaatatttttatatttttgaggtgttaaatacatttattttttaatgaaatgttgggataattaacaagaagatactgtgtacaacattagtcttatttataatagggttggtttggagatattttcaatttaaaattaaaactaaaaatgacagattcggtttaaagatttttcaagtttagtatcaacttaaattaagaagtcagttctcaactttgcgagcttaggttgtttgattaattgaataaacagacaactactgatatgttttcaggtactgtaagaattatttatggacgaaactttcaatttaataaggctaactacttaattcaatttcatttaatgtactcctaaaaaaattcattttgcacattttttttggcatttataaaacgttgtttatattgcattgtatcatgaactcacaaatgctaacatgccccaagtaaagcattggttgggtgaattcagagtaagttccagcaaaaagttaataactaataatttaagatattggaatttatttaaaatattaacaagagttaataattaatcttttaagatactagatttattaaaaattgaattgtttcaatagattttttttttattgcttgatagatgtcttttatacacacagacatgtagatcgaattcttaaacatatacttaggaacatgattatatgtcaactatgtcatatgtaaataaaaaatattgattattaagtaaacaaaagcataaaacattttattgaattttttttatttttattaaaatataacattattttattattttacttgtagtgacatagcaagtaaaatttcaaatctattcctttataatacatttttcataaatataaaatccatttaaaatttgaagcatttatttacgtataaagataatgtaactattcagtaaccgttgttgaaagtgagatatgtgtgattgaaactaaaaaacgagagttatgctgcatcggttaacggggtgttgagtgtttgagtgcagaaaactcttggaagttgcggaaaatggggaaatctgttgttggaagaaaacgagggttgtgaggggacaagatttaatttcatgcttcctagggcacaaaacgtcttgctcaagcaagctatgtgctatatactatataatcgattaccttatcatgacaattaattgccttatcatgtgaaccagtgaataatgatgttcatggtaattaagcctacacgtcgtaaaaaaaaaaaacccgctcatgtcacgctttttattattatcattattatgtgtacacagttttcatgaatcaagttaatttcacgttgaaattgtgaagtaatcatctctatatatgtgataaaaatgaaagtttcaaatctgcacttagtggaaaaaattggtgttataaacaacagtctgtgactgtgatactagcatccaagtcattagtgtacataaccatcatcaattaatcaaggttttctcctatttggaacttggggagcatatagtcttagatgttcctcttaatgatatatgaaggatgaacattagctaaaaataattttaaataatttatttgtttttatctttttttcttctatcacatcataaatcttataatatttatattatttttttctttccatgtatcttatagcataataagtgtcaataaatcatttttctaacaacaaatctaacacagataacattcccattaataattaataactaataataataaagataaaactgacacaaggcacatatagtccatagaaataaaaagtctaaacctaaattaaaacaataacttatatgtcaagacagagagaacaaataaggtattgtttcaatttggtagcagcagctatatagtaaggtaaacttgaacatcatacttatataccagaagtgcttaattaaatgctaacacaatgcaatgaaatttgatttgatggaaatatactccagttattggtcccctccacatgctttagcatgcaacagagtatgcttgcaaacaacaacttcgaacactgaaaaagagatttcttgagatcagtcccacttcttgcaggcctctaatctggattccccacttagctctcttttcaaattgataagcacatggataacaaagacaaaatatgctttcacatgatcaagccccaaaattatgatttatttatggcatcagataaaatattgtgctatagcacaaaaagaaactgtattatatcaacctacactagtatagtacacgtgctttaacacatgtcatgtttgttgttatgaacatttgaaaaacactcatatatactaatccaacagcaaaagtggtggtggataattgaaaaattagaagcaacaaattataaccgtgaaaaaataatcgatgtagcatcaacacaaatatatccaacatacacttaatcgaaggatcactacatgaataataaaataggaagaatgctatgggaataagtttcatatataccaaaaacgatgtgtggctacaagcccgcatgctacaactattttattttatttgaaacagacatgctacaactaattgaatgtgtaaatattacttataaaagtaatgactagtatattacacacaaaaagtgtacatgtcctgcaaacaataaaataataaaataaatatatattaaattccaattacatatattttcaaacaagactaaatattaatgaacttattttgcgtaatcattgtgtttataaacataaatttttactaacaaaacctttgaattgataatttttattcaatatatgaagtttataaaaatcatgaaaatttaaaactgatcaacattttaaataattaattttacttttatgtataatattttgaaaataaatattaaatatgaaattatatttatataagtgtttcattttttaaaatttaatatatattttcatcaaaacaatgtcctgcaatttcactattaaatttacatttgtttgaaaaaactattatgtttaataaaattctgttttaaacacctatcacatacttcatctagtcgttattagaaggttgaaattaaaaatatagcttaattttttttataaggtgcaatctgaaatttttggtgaattaattattttttttacaaaaatatcttctattaaagtccgttctaaaacgacatggtatggagagaaacacaattaattaatgtgtgttagttttgttcataagaataattttatgagagaaaaaaatagtattttaagacaaatttaacgctcttaggtaatttaatcaaattacttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatacatttattttttataaaaccaatattttacttagtttctttcaaagacggaatgcataaattaattttaaaagagaaaacttgatttattttataaatatttaagagagatgttcactttaggaattaggaggttaaatagtagttatattaaagggaaatgctaatcagtattactaagataatagttaaagaaaagaaagattttttattgacatacgtaaaattatattaatcataatttttttaaaacttttatatgattatttttattaataatatcttattcatgtagttatttgatgaatttcttatggaaataatattagaagtatacttagcaagtgaatctctgtgactttgattagtgaattttcaatgacgaaaaaatcagaaattctagaacattaccagcaatgatgagaatagaaggataagcatccaaatatcgaattggtgtgtggtgtggtgtggctctttgaaggaagaaaatggcaaaattagagtcagcagcggaaaaagcacgttggcaaagtccattgcctcatttcatcaaagactgcaccctacccttgctgctaacctcacccgcctcacttcctcaacgacctctcatacgaagccatctgccaaatcgcctccacgcagctccgcctcgccctcagcgtcctcctcgactccccgctcctccgtacaagccggggacgtgggaggaacgggagaagcttctggaagggtacggagggtgtacggagtacgacgttggtcacgtgccaaagctcgtcgactcgtcgtcgatacaacctccaatgtccccttggaagatatgtgttccgctgcgttggagtttatcttcgctcaccctgctaagccacctgcgattagccacgtggctttttcatcgttcgttctgataatattaatatcttctttcttctatgatcgctggtagcatatataggataggattgtaaacattataaaaaaaaactattgaaattctacttacttgttaaatatatatactccgttgtagtatttgtttatttagttaaaaacaaaaataacttttaatctctacaaagatatctattatctaataatcacttggttcttataaataaaaaggattttgtaaattatttgataggaaagaagcaaaatataaaaaaaaaactttatttctcttccttaaaaagataaatattcataataaagaaaataaacataaaagtaaaaaaaaaatagttttcctttttttcctcttttctctctcccaaccaaaatggacagattactataacagtgaatttcacattctttttattcattctttcccccctcaataccaagcaaaagaacaattgaaattaatgtcttctttcatcatactcgtatttgtttcgctggttctcacttgtatcaaacaaataataataagattgaacctaatctttatgcatctattccaatttctaccattaacttaactgtttatttatatgtgatgaatttataagaactcatatatatactaagtattttaaaaccttaactattcattcaaggaataaagtattaagatttttaagttatcaaaatattaaatgttcttttatttgtttcaaatgataattaagaaggcttcaggatgatgcaccatttcttttttattcttcagaaaaatctataccaaccaccttagtggcatgaaatgtgacagcagcgacaggaaatttaatgaaaaataaataagtactttatgctttacataaatgctttacatgtttggagaggtataaaaaaagaacaaaacaatatacataaaaatcgaaatttagaaattatctcaattttaagaaccaagattcgaattgagttcaagccttcaaggattctccaacatatgtgtgtatatatatgtttgacatatgtttagattttgtacgatcaataacgattaaatattgtaaaaaaaaaatgtgaaaactgaaaccaacccctcctagaatttgatacacctaaattccaatcgaacaatgatgctatctgcacgtaattaaatgtgttcctttgtgttggagaatctgcaattttcaatattcctttttgaaattgttattagcaatttagcacgttcattttaggatgttctggaacgtagaactgcactgaaaatctgaaatccttatccaaaacaaacaaatttacgttggacccacttgccttcagaaagctgatgatacctacattactgtagtctgtagcagtaactaaagtttttactatccctttagcagagcgatttcctattttggccaatacaatatttcaatattctatcgcatctttttttccaaactttgtttctataattccacactctcataactcggaatatagcaccatttgccgaaaagagaaaaagataaatgcgattaatgtgcatcctaatcctttgcgttttgtataagttacaggtgcaatgcattaggaaattggtataaaaaaaaaactatcacacaattttcatcttattaaaaacagcaccttgaacatgacaaaatttaaatgcagcttaataaataattagacaatggtgaacattcaaaatccaactcatttaaattttaatgtaaaatagaatatttaagtgttgttttcaattaaatttttattataaataaaattttcattaaacataattataaattattgagataaaacttcgatttgaaaaataaattaacacatacaaacataaattattaaaataaaactccaattttaataaaaaaaataacacaaaaatacacttgacatataaatttgtcgttttgaatatgaattaaatgaacaaacaaagatgtccgagagattaagtgattcacgaatgtaataactttttatgcttaaattccctaactactttttcctcctccaatcacatgttttgtatatgcattaataattgtgctgaaacatgaaaactagggacatggtcacaatatttattaaactttgggtcatgctaagaagacgagaaatttgagagagaataagaaaaagagaaaaagacagaacaatcaacgtgtagtttgcgttttatttctcttcaagaacacagggagtctcggttaccgagcatcatctctctctgtgttttcccatatcttctctttccagtcgttggtcaacctttgttcattggttctctttctctttccatttcaagtcttcgcttctttggttcaaaggacttgagcattattgatgttaaactagccatcttcttcagtttcttcttcttcttcttcttcagcgttttcaagcctcttccaagagtctcttactcaagattcgcccctggttcattctctcaagctgctgctgagttcatcttccctcttaagtcttaactcaaagggtaacaccctgtatgtaatatttattcttcttttgctcttaacatctttctcatgtcagttaagttctaaaagttcaaacttttttgctctcatgcctcaatttatttgatggatgatccccagatgaaaaatcatctcagtttttgcttctgggaatctgagttttgttgcttgacttgcaagtgactttggtcttgtggttggcgaaacagtcacctttctcaattttgcttatttaatttgagcttagtttgtttggttatagattgtgttagctagcttttcaatttgagatgggtacttaaaggggtttaatttcttcttttgcttctaaatttagtcaaacagtgctttgactcaattggaatctcctatatttggggtcatggataactcatatgattcatcatcatccttgagtttcgtatcatctcacctgtcacatggttctagtaatcacaacgtgtcttccaccaccagcaatgagcatggggcaaatattgaaattttgagtctgaataagctcagtggaagccttgagaagctattgattgaggctgactatggttatagtgatgctgagattcttgttgaggacatccctgtgggtatacatcgctgtatattggcgtcgcgtagtccgttttttcatgagctttttaagaaagggactgatggatcagggaaggaaggaaagccaaggtatctcatgtcagatttggtgccttatggcacagttggatatgaagctttccaagtgttcttgtactatctgtatactggaaggctaaaggcttcaccaacagaagagacaacatgtgttgatgaaacatgtatccatgtagcatgccgccctgctatcaattatgcattagagctgatgtatgcttctgccacttttcagatgaaagagctggtattactttttcaggtattttggttgtcatttttagttcttcttcctttatcttattactaatttttgcgtgaaaaagaagaaatgtgaaaaagtcagagcaattctacaaaatcattctgggctgaataacatagaaatactaccagttaaagtttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttatcggcaaatatattagttgttagaatgcaagttttattagtagaggggatcgacctgtgacctttcctccacttcccttctcccttaaccattcaacccaccttatatctccgtcctacccattaaagtatcccaatgtttacctaagactaaaagcagataaacattttacatttggcaagttttggaaattgtttccaacttacatgtgtgtctttctgaagtgttcaacactttatgtgcctagtgaacaaattttggaatagatgtatacctagcctaacttcacacacatacacttgtcactacattatgtacctttgtccactaagctcttctgattttccactgctgcttttaacttctaacttatatcttgaggatgatattttgatcctatattacttctatgtttctctattattaccaaaaaaaaaaaaagacagacatcttttgcttaacaaatctaatgtaaatatctctttactgatgcagcggcatctcctaaattttattgagaaagctgttgtggaagatgtcatttctattcttatggctgctttcaactaccaactagaccagcttctctctcagtgcattcagagagtagcaaggtctgactttgacaacatatctttggaaaaagagctccctcatgaagttgtgactgaaatcaaatcactccgactcccatttcagccagaatccacacctaatgcaatggaagtggagtccttgaatgaaaagaatatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcacgtgcatcagataccactccagatggacaaaccgctcttgcaatttgtcagaggttgacaagatgcaaggattatcatgagaaaacagtgcagtgtaaggaatctaacaaggacaggctctgtgttgatgtcctggagagggagatgagaagaaattctatgattgtgaatatgtctgtttcatcacagttaacagctgatgatttgcacatgagactggattaccttgaagatagaggtagggctttctcttgtctaggtcactttgtttctatgaatattgggttttggacctcttagttgagttggaaatttgaaagggtaaaatccagaaaattattttccattgttcagaaaaatacatagattgatacaaatatataaactctaatgagactattccaaatcgggaataaatctgtgcacaatcaaatcctcctaattacagtagtaatggtaactttttaattacaaatgcatagttaataccagtaagctgttattttactttaggaatatgcatgcatcataaccacaacaaaactatatttgcatgatgcttttaaatttggaagcctatggacatgaaattaacatgctccatatgttgcagttgcatttgctcggctgttgtttcctgctgaggctagggtagccattgagaatgctgaagcagattcatcatcgctgtacgcatattcatcggctttgaagggcaaaaatggcaacccgaaagaagtagatctaaatgaatctccctctgctcgaaccaaaaaactccagttaagattgcatgcccttatgaaaacaggtatgtccaagacaattttgaaatagcatccttatagaggttatgcatctgtggaatgtggatatgatttattctattaacaccaagtctagcttgcttgtatgttgccttggttggaacatgccacaattgtgaaaatctcagaattacatgatgcaagccaacaaaaaagtaaaaataaaactttccacttacacagatggagtgtagtaactactaattaacaaagaaactttttatcacttgtagtacttcttattttattttatataagcaaagtttatttaaaaacacagtacaagggatactctaactcatgtacaagagtgttataagaccaaatcagagggataagagacaagttataggatcagtacaccaatcagaaaaggagcattgaacactacttattttttccttaaagcatgtctacgatccaaccttaatcaattttagatttctagtgtgctagtgaagttaaaaggaaaccctgaaacaaaatattgtttctcataatctaagtagaccatatcatagcgtaccaaataagatatcaaatggaacttaaaactaaccatgcatttgtagtactttacagcttaacacaaatggaaatgaatttaatgcaacttgcaattgtagaggaaaagaatgatggtggtttaatgttgttattaaaactctgagaatgctttttgaattatgtacagttgagaatggtaggcgcttctttccccattgctctgaagttcttgataagtttctggaagatgacgaaatgccagatgttttcttcctagagaagggaagtgaagacgagcagagaatcaagaaagcacgcttcatggagcttaaagatgatgtgcagaaggcatttcacaaggatatggctgaaaataaccattctagtttttcatctgcggtgtcttcctcatcttcctcaactcgtagggaaggtcttaaccatagagtaaggagaaaatgaagtccatgttcttctatgtagagtgttgcaacttgcaagtagaagctgtggaatatttagaaaaaataagatggaatgttaaattagggggtttttctaatgaacatgggagatttttactagcttgatttagtttcttatagttgttgtaccaagagaagaagaaaaagaaaagaagacgaattggcttctagtaatatctttgttccttttcgaagacccaaaagtgttttacattgttatctgattatagattgttatataattgaaatttttacctcctctaataattactttaaagatcatatgcagactttttgaaagtcatttttaattgattatccttgctaaattgtatctatatccattgtacaccaaaataattgtatatattgaaaacataaaaaaactaaactcttgtttcagttgcaacaaggagtaacccttatcttcaacaaagtaatggaaggtttaatgtggacttattgctaggttgagttttgtttagaatattttttagaattgatatattaatataatataattgggcatctaaaaagactagtgggatgaatatcacctttactgttgaagtcattagttgtaatgaaatgataattgtgatgttacacgaaccaaccaacttaaaaggtgaaattagattttctttttcttttcaacaataacacgtgagattatgttatcactatcagacatcaagccataaattatttatatattaaaggattgatggattccagcacaactcttggagagtctcaagattttttttttttccttattttaatcctgagttagaggatctaaatttgaaagggtaagtcatttctccattttttctttcttttcttaatcttttgtttgttagaatacaagtttgaggtgaagtctcacattaggaatgaatgagaaggttgaacaccatatgattgagaatcaagaaacttgttggtagaaagccccaaaaaagggtgtcctcttaagcacgccacgcacattaactagataatagaattgccacttttaacattgattaattaatgagtaaattatattttcatttttttcatattgcacccggtactcctctctttctatacattacttttaacattttttattaatgtcgttaactaacatcaattaaaatatttaagcagacgaaattgtccgttaaagtaaattacacttgcatctcctatgttttttttcaaattgcacttgatacccttcttttttatacattacttttacctcttttgttagtgtgtagggaaccagaggcagcagtgatggtgaccgaagttacgacgaaggacaaggaggtggtggaggtgactatggtagtggcgacgatggctacagtgaaggttgtggctacggttacagtggtcgttctggaaagagtgggtgcgctcggacgccatgtaagtgggcgaggacgacaatgagaacaagagatgatattgtcatgggagagggaggaggaagagaaggaggtggtagtggtaagtgaagaagagttgttaaacaagaggaagatttgtaaaatccaaaatgtgattttgaagaagaaggcgatggtgttttagacataaatttttattaaaagtcatgtgactagtatgtgtctaatttctgttaaattatcaaaaggtgtttaggagagagagtctatgtgtaatgtgagctaaacaattaagagattttttgtagggtataaaaaaggaagaatatcgaatgcaattaaaaaaaaaaggagataagagtgtaatttactcttaattaatcaccaaataattcttgcaagtttgcaatgtttataaaattcattgaatgggacattttacatacaaataaaatataaataggatagaaaaatactgattcaataatagaagagtttttcttagtgagaaaaaaaaacatttgtttaaaacttttagtttagaaaagtcttaaaagtaaattgcagaagattgttttcgaggtaacttgtaaatatctaatggcaattaatttgatttaaagattgattaaaaagttaaagaaattcatatattgttttttgagtaattaattaaggatgattaaattttgatttgataagaaagctctaagtcatataccagaaaataaaaataaaaaatggaactcaaaattaaactgttgtttcccattgaagaatgtcctctgaaatttataatatacaaatggattaaacatttttccttctttttttacacattttaaaactgattatatgcttgcaaactgattaaatgaatgggttgctcttcaacacatgctggtaacttgagatgtatacagttctaactcaaaagtatcacacattgtataacagttacctcctaaccatattggtaaacttctgagggcctagaagtgaaaaaccataggcagtaggtagtgacaagagtttctttacttttcctacatatgccctttttgtgaagttattataatcattggcttcaatggaatctaatatttgcctatacaacaacaatgatgcccacacaggccacctgctagctgagttgagctctgcaacccctctctctgcctcatcaaaaaacatcctcgccctctttatttgtcccttcatgaatttccgccatttgtctgtaactcttccgcggaaaatgtcatcatctgaaaggccagcttgtgccaattcatcttgtgggagatatactcttcctcttctagcactataatgatcaagaactagaccaagttagacaaaacataatttgaatgatgtggacaattaaaattaagagtttaactttcatgtatgtaaattaaagatttttatattagaaaagtaattcttataaaataaacaatctttttatatatgataatcgatataattaaattctaaaattgaatgttgaggggcattggcttaattgattgtatgaaacaagtgttatttttattcatttcttggaattgtgatgtgagatacccttaagtgacaagatgttcaatgccatttgtttattgtttttggtttaattgcaatgcattgaagtgttcaaagaaccttactcttctccaacatctctaagtatgttggtaagttgatttgcaatgcctagagccaatgcagcattataaatgctctctgttgaagcatttgattctggtgctatccccattactgggacactcataaggcctactgtcccagcaacatagtaacagtaaaggtagagctcatcaaagttattgtatctagactttctcaggtccatcctcatcccttcgatcatgtccttgaacggctgtttcaaaaagacaatgcaatgtcatttggatcagttttagcacataaaaaagaaggtgaaatctagttttataattttgtttttcgatagaattagtcctctattctgtataagataaccaatttacttctagtctctaatttgaacatgttatatctaaaggataaaacttacatagttgcataggtgcttttggcattattctttatcccaacttggagtttcactttgataatatgcataataaaggtttacataaatgtcaagtcaacatagattatcaaaggtgaaactcccattttgatagagaacaacatcaaaatcaactaaagaactttttatgtaaggtttgtcctaaaatgatgtaatgcttagatttgggcatgtaaagtacctgaatatcaacagggtactttgagacagtatgtgagagggcagcatcatacatatcatagggtcggccttcaaaaacatcactcaatcgttgctcccacctgtccaaggccccaggggtgatgtgtgaagcatttgggccatccactagctcatcagttcttctgcaccacactgcaatgcgcaatgaaaattgtcaattccaaaacaactctcactggagaagctgaagtagcagtgtgtaatataatctaatcacacataccataaattgcccaaattgcttttcggcgctctgcagtcatcaattgtgtgcctagagtatacagttttcaagatgagtcaattcaacaacaaaatatattattaacaaataaatttttaaaatccattaaaaatagtaaaaatattttaatctagctgctaagtacttttctgtacacagcaaaacaaaaggcatatatcatatgaattgaactttgtaattagacttaaggtttaggaacaaaagaaacatttcaattatattaacgttgtggtggaagaggagaaattactagatggtctgagaccatcattgtctcttgtctcccacaatcttcacatgacacataattgaattttatgaaatatttgtcataaattaaaaaacttcattatgtgacatcgtgcaaagattaactgagatcatgaacacataataactttgaaccatttaataattttctggacattatttagatatgatggggaacaaaataagaggactaaaattcatttgaatcagaaaaaatgaatgagaaaaggctcaaaacaaaagagcagcaagtacctaagtaaaatgtcttggcatactcagcacaaacttcaccacaccgatcataagccgcattcaacagatccacattgttgaaatcagcctcaacgtctttgtccaaatccagagctatgtttgtaccccttttgtgttcttttaccaaagctgcttgcttcagcaccacttcatagaccctctcctctgaggatcttgaagtctcagtagctgccactgcacttgaaaaagcagaagcaccactagcaaaactgattccagaaaacctcttttgtgttctttcaccaccactactactcctgcatgaaaaactcaccaaggagttgatgttctctttgggtccacaactcacccaaagaagaacaccagacatctcaagaacaaggcacaattttcactgctgttggtgcagctccacaagtgaaagtgcacaccaatgaaaagagagggaaagaaattggatgaaaaccttttgagaatgagtgtatacttgtggtagcaaaactatgatgaggtttgtttttgtttgtgaggctgtcacaaattttagaacctgcccaaagatatagaggaaattgtgaatgtaatcctatagccttaacacatgtcaaaatgtatggacagtggccttgtaatccttaacgtgatcaacttgtttgtctttagtgcacgatcctcttcactctcagcctctctattttgagcacaattttgttttgttttctttattttattgtagccccagaaaaaaggggcaaccttacattacattttacgtgtgtatgtggtcctatcttttgttttgcttgtgtagttgtagaatggatggcttaaatgcctttgatagtgtttttgtaagcattacttgtatagtttaggtttgtccagattcagagtcataaaacaaagggatcaacatcaattgattaaatagatatgagttattataaattctcatatttatctttcttttttaccgataaaaaaatatatatttagaattgtaatttttttgttgagtctgcatctcacatctaaataatgtcttagtaggcagacttaattttatttgatatatattatttttcacgaaaggaaaaaaaaattgtattttacaataatacattaagtaattttactcgttgttttttaattaattggcacactcacttaagtatgagttagaaagtacaaaagggaatcaatgcatccaacactaagaagatttgatccacaaactagataccatgttagatctatatatatattattatgagggtaaagagacagcaacatatgcatgtaattaatgttatggttcattatcaattcctccgagaatggaaacctagctctttgttttttgacctacgattttttattttatattcaattaatttttttctactaaattgattaattttggaatgaagtgaaacctgacatgatagaagcaatgctacttgtagattatttaatcaatcttttacgtttatagtccaccccgttaactattttgactaaaggcactatccaagtcaaatgattaagaatatatcttattttacccaatccatgatataataacaggcttaacacttcatcacatgcatcacataacaattaagttaaactctgaaaccataatacgacagccgaagtaagacatacaattgaggattattgatttgaacttttataaaagttaattttaacttaaacataatctgaatatttgccacattaattgctgaaaataatgataaactaaaataaccaaaagctgtaaattcttttttgtcatgaaacacgagatgccataggaatattcgactttcgagcctcaagcttcttccttggggcctcagccacaacctcatgtaaaacaaattgaagcacaccaccacgtgcactttgtgtcaacttgatggagctgatctccaaataacttatgaacgttttccattctctatcgtggcagaaattgaaccaaagcttaaactgcctaacaggctttcaaatgtagaatatttaaaatattaattagagcataaagacgaatatgcttgatgttgttctttcctaccacaattaattaaccttgatgccaattcagatgcatcaaatattctacgacgaatacgacaagtttggaagttcacacggttggtttcttctttaaataacatcaactcttcaagtaaaaccaaacataaatgctgactatatatattatattgcaccttaattaaacattacattaaacatttcaatacaacccgcggaaactcgcaataaaaattaattttgcataaaacatttctttttctctatcacatgaataattaattattctgtaattacatctattaaaaaagttccacttcactttttgtgtgtcaaatatcacccaattagtcattttataatacatcttgaaatgttccttgttaaatataaataattaattcacgtaaggattgtagtcaaagtcaaatatgccaagacttgaaatgccctttatataacaatcaaagcaatgcaactgcatgctataataataaataatcaacagaatataagtttcagcatatataactcaaccatgctgccagttatagctaattgcagtagtagataagaaatcaaatcgcaagtgggcactttcaagtttttaacttattgtcctcaggagcgtctagattcttggagatggtttcatacgtttccttcaatttttttgagtgttaaataactctttctaagcatttatgagggatggaatttagcgtagtttaaaattttgaacgttggcgtcacattgacaacaaattaagttgttcctcttcctccatgtcaaagcttcaaagggatatggtttcatgaacttttagaatcccgaaaggactttgtctttttctctccatttttatggtgaatgtatgtggacaactagctagctgggtgatcaaggaaaggccacgataaccaatcagaaccaagttaatagtgagctgttaatattgtcaagcaataaacaataaggaacttggccagaattttctttttaaatgtttcatagagaacccaatgctagctattttacatccgaataaagaaagaaagaaatagctagaacagaaagatgtgatagtagtagtatgtaacaaaaagaaaacatgaaaaatgagaaatctcatgaagtacttgcatcgtttcgaggtgttcaaacaatagtaccctataggctgagaaaaccctaagtagacaccatgaatttcggcaaaggatcggacaagggcgaacgtattttgcttttttaaatcacaaaatggttataaaatttatatatgtaaacaaatacattattagataaaaattaattgttataaaatttattatataaacttatatgtgtattaaatatacattagaaattttaatattatatataacgacattaattatttttaacataaatagctcagttggtttaaattgtccaatccgtataaaccttataaattacgaattcataatgctcttaaggattagaagcttttatcaaagggtaatatcggaattgtaatgtttagtgtggggtatattgaaaattcgtatgatgtaggaagcaatatgcctagtcctcttgggtcgtgaaatgtgggctgagttgctaatagcgattgtcatccgaataacccactcaacgaccccttattctacccgcagagagatgattgtaattggtagctttcaagtttcagagcttcggatcgagtatacacttttgggtaacgaaatgaaacgatgttgcgtaactgcagttgcacatgcatctattatagttaatttagcttaaaagttttgtctacggtaattttatctgtctaaagtaattttatatattcatttattaattctcaactattttttaagtaaaattaactatatttacccatataattatgggatttactaatttacacacatatttttttaatatgaatatattgacaaactatatcattattgtattttaatatgtatatatactgcaatggcaagaattacaagtaaaaataaatactagcgtcacaccaacaccacttgatactatttgtatggataaaattcacactagaaattattttcccttgttacaaatcaacaagttgcatgattgatgaagaataagcaaaggcaatgacgattaattaaggaggtaatcccaagagaaaggcctaagaatttgaggagccctaacctccatgaaattcaaatgagccttgagaaggtgcatgtaaaccaaccaatcaccattcccattagcacaaggcattggcatgacatagccagaatctccaccccaaggaaaatggtacgatgcaaacacgggcttcccccacccaaagtcaacctttgactccggaaacctttgccctgaagagacaacaaaacttggtcctttttcttttccatgcccacaataaatccttgacaaaccaggcacaggtcggtgttcttcaacccaatcaacaagccctaaaaaatggtcttctgtcacacccatcttcaaaaactcatgaactttctccgccacccaactcaatggcttttccacaaactcatcaaccgcattcccaccataaggaatcgaaagaacattgccaaaatacgaactcatgttcttttcatcgttgcataacatcttccttccatcaaccacaatacccatcttggcaacaacgtttttcttaccatcaacactagcagttgcttcagcaaccatcttccacaagaatgcagagaaagactcgacctttgtgcgcttcacggtaccgtttgagctagctagtgcttgcatgcggttcaggtattcgcttgtgacgtagtatatgcggctgatgagtggctcagatttgaaaacgagtttcttattaggatctgacggtggaggtagcgccgagacgggaacgtacatgtggtggagtgaagggtggatggaaggtgggcgtcgtggggtaagaagggagcgtcggaaacatggctgggctgatattatgggcttgttgggccgggttgtttcggcccatgatacgaggaacatgttcgcagagtaggcatcagctgtgcgatggtcgaaagtacatgcaactactaaacccccacacttaagctgagttgcctgcaaaactcacatgtcttataagacaaataattaataatatgttttccgcgcgattaagaatcaagattttttttatttatttagagcatgtttagtgtatgagcaagcagcttcaaatttggtatttcttagatattataataaaagaagtaaacaaatcttagtcatggagatgcacattatttaaaatttttttttttcttgagatttcaaaatgaaatttattattaaaataataaaagatattttgagaaatcttacattttacttgacaatatgaaatccacaaaaaatgatataaaatctcaatttgagatctactactaagagcatttttaatgcaaaatctctcaataaagaagttgaagagatcttcaacatggagaatgagttcttgtagaaaatccctcaatatctatacaatgtttaaaaaagaataaattttttccctctttctctctccctaagatctcaaaatgagatctactattaaaaaaaaattagagagatcttaaaagatcatcaattctatgtggtactataagttcaccaaaaaatgatttaagatctctatttaagatctaccactaaagatgctctagatgttataatacttcatttctttaatcctatatataaaattcaattatctaattcattaaattaaaaaataataatttaattaatattaataattttattttaaatttttaatattttataaaattatcattatcatttatatttcatttttttaattatttttaatatattctttttcttcttttaatgatgaacaaacagttttaaatttaggtcttataaagtataaaaataagtttgactaaccagtactcttataatacttactaaaaaattcaaagaaaaaagattttaatgtaaaattataagaaaatatagaaaaaattaattatgactaacataatttttcacatctcaataaaaaactttattcttttagttttctaacctatgttctaatatactagttaacatatgctggtaaacattttcaaaatataggtttgtttatgaagttgttttatagtgtatcacctgaacagcaagcacgccatgtttcttccttggtacaagcttcccttcaacagtgtcatcaggattgtacaagttgaggcactgtagttcaacatcagctacagcttcaaaaaaatctaccccacggttactgcaaaacagctcaggctcacccatggtgttggccaccatttcaccagcaaaagggtaatagtatactagagcccgagccagtgcatttttcagtgacctcaccatggtttcaaagcaataatatttttcaggcaaaggttttttgtagcagaagaatacactcacgtctactgggggaatgagtagatcaaggtttgatagtggcagccattgctctttcattgaaagctctggtaccactacctcctccttggtcacactcacaatgaattctccttctccaaccttaccatccatttttcagaaatattaaagctgtgtagctagctaggcttgttaattcaccatggcagtactacttgattggctttttaatgcacaggctgtaagggtcgcatgaatttattggcagtggcctagagagacatgcgaattgaatgtgcaatgtttgatattaatgtcaattttaagcctgatctcatataacacaatttgtatcattaattcaaatcacgtttaattgactgaaaaatactatttccaattgtagtatcttgtacttcccgaacaatatcaaaacgtttgttgtgtgtaaatattactgtatttctgataagaataacattaaatgtcaagtggcaaattaattatggtagttgttggtgaccacccgcatgcttcttacttagttttcaattgagtatgtggttctatatatatccacttaaggtctttcatgatggcagaattggggacctgtgtgatgctatatatcacattaattaattttcactccatagtattggctattaattaagtgtggcatatattacttcttttatttctggcaggaaaaagtcactggactaataaaaaaagcaatataaaaccgtctaaatctaaagaacattgattggtagtagtatattaccaaaatataaaaatcataaattaaagactaacacctatttgaaattttttaaccgcgacaagttgtcaaaatcccctcaagtttcaaaaagaaacactgaggaagaagtccaatggtaagctactgagcaaggcttttagtaccaaaagctgctattaataaattgttgtgttttgtagaacacttcataaggctcatggttttttaggttacaacataacgatatggtttagctttcctttaagtgtatatataaatacaaacaatatgttttaagaggtttcaaacaagtataaccaaagtgtgtgcttgtctgcatgaaattgctttaagtgggctagatggagtccaaattattcgatttatctctcttgcgcgcccattgaaacgtgcctcatacaaaaaatggttttctctttaattaattatttccagagattattaaaatgttcacaattttatcttttaacgttcaaattttctcccaatctccactaaaagttaatgctttcattctcagtttttatataccttttatctgatttttttcttcttatcttatcaccaatttttgaaagctttttgttcctctctttccttctgtgagaagtctggattgttatatatatatataaattacttatgcgcttgtcagttctgcgaatattttaacttttatcatttttttttattattagattctaaacttttttcttctctcaattggttggccgaatgaccaaaaggataattcttatcaattgaaaacaaattttgaattaatactcaaataaaaataagtcataaaaatatttataacttttaattataaaatcataaaaaattgacaatttttttttaaatcataaaaactgaacaactttaatttttttttctctttttatatgaagtcgtaaatttttttattacttcaaagtcataaaatcttttacgactttcaatttatttttaaattttaaattattgatattaacaaataatattaacttaaaatttatcaaataatattaaattttttaaatatttttaattagtttttacatttatcattaagtaaactaataactttgtataattagttaattaattttatttgataaaatcattttaatattaataacagaaaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataataaattaaaactaatttagagttaattcaaaattaattgatgttttaaaaaaatggcacgagttagaaaacgttttacgacttcaattaagtaactaaaaaatgtaacgattttgaagttataaaacattttatgactttatataataaataaataaataactgaaatcatttaatttttacgatttaaaaaaaattgataattttttacgactttataaccagaagttgtaaaaatcctattgcttaccccaatttgatattaattcaaaacttatcccatttgataaattcaaaaacgaattacccattttagtctttcgacctcaattgctctcagaacttatatttatttttaattaggttcaacaagaaccgacagatatctcgttaaatagcaagaaccaattataattaataataattcagtgacttatttaaaaatgacaaatagtttaaagatttaattaaaaaattaccaacctctctgtaggttaatattctcactagtgtaagtcagtatttttttctcttctggttctaaactcaatagttataagtacttcaatcagtttataacctggatgagtgaaaatactatcatgcagaacctaatttttttaaaaaaataatgctttcaaacaagtaatgtgttgtgctcctgcaggcatgaaatcggttttattgaaaatattgttaagaaggtatatgaaaatatagatattttaaacctttacatactggtctgaacactgttggactcaggcctcgcatagaagatgtgaaatcacttctagacaagaagtctgatgatacaactgtacgcatgttgggcatttatggacttggtggagtcggaaaaacagaacttgccaaagctttgtacaacgatattgtgcaacagtttgatgctgcaagttttcttgccgatgttagagagaaatcaaaattttactcttggctttggattccagtctttcttgattcaccttgcatcatgaatgtttggaggagctgttttttttttctttccaaaagcactaaagcagaaagcttaatccgagaacaaaaaaaagaaaaaaatcttactcaaaaccgctaaggttttgattgatgtagtgtactagaaaatttaaataacaatagcatcataatattaaaaacaaattaaattggtaacattcttaccttaaccggtccaagttttcaaaggttgagcaggaacaaaggatcatctaagtctggaggaaaacctctctctatagcctaaaccaatcttccagaagataagctatagcctctcttagtaattaacacagcatttagtgttgccctcatctttgcttgatagagtccattgagaattccttctttatttcctgatacaatgctagaaatgttttttaaagtttctctactgaaaaaagttttatatttttagtaaaaaaactctcgatagcaatattgtcaaagtcgagagtctacgtaaacttgtgggagctccgtagactcgactcatagactagaatcatagaatcgtaagagtctatttcaaaaaaaaaattacttatataaaaatataaaacataaattgatacaatcatacaatgccatcagtgcttgcaattagcagttagcatcatgctatggaaaaaagaatcaatattttttcaaaattgacatcatgctattgcaattcaatgtatacaatgccatcagtgcttacaattccaaatattatttggaaaaacagtcgggaaaacattcagttagcagttagcatcctgctaaccttttagaggaagatttaaggacaccatttctttaatcttttgcagataatcttgttcaaaacattcataagcatttaactcatggtacaattcctacataaaaggagaaaatcagtcattaaaaaaggaatcgctaaaaaatttcaattggaaaacctgattttaaccaaaaagaacttagtaagctatcacaagtaggaaacatcatcaacatcaatatcaacagcacttttaactcaagttaattggggtcaatggtagatgaacccaataataaataaaaaatgagacaaagaaagagaaagggggaggggaaaaaaaagtggaaataagacaaaagagagaaaaataagctaacataaaagagaggtgaaaggaagaaaggagaaaagaagaggaaaaagactaaaacaatggaacgactggaacatataactactattaggtttaacccttcaccaaacttataacttttctccactctgtcctaagacatatcgtccaccaatctatatctcactccattaagtattatttaactacatttccccaggtaagtttcggtcgacctctatctctctttgtatcgagctcttgataacaaactattgttcttacggggcatccagtgatcgtctcataacgtgtccaaaccaccttaatctatgctccttcatcttttcacatatcggtaccactgatacctttcatcaaatatccttatttcttatcttatccatcttcgtatatctacacatccaccttaacatcctcatttttgtaacctttattttatgttcatgttgtctttgtgctgaccagcattccgctccatatagcattttcaatcttatagttgttctataaattttccttttagcttaaggagaattttgtggtcacacaaaaacccagatgcactccaccaatatgaaccaatataaatacacttgtcggtatgcctaaaaactgcatataggtaataccgaagatccatgaatcaaaatcatgcagcatatattcaagaaaccaaaatgatgacaacaactttacttagtcaccagtatgtcctcgtttccctgctgctgaggatcagaggttgaagcttctcctacaacacccacagccacagctgccttcacttcatcctttggtatcgaccgtcgaatgatctcatggaggctttccattcctctccacataacatgttatattctgtgcttcaacaagtccatccatcattgcatcatagtatatttccctcgttaattgttgcagctgaggattgtagccttgtttctcatcacttccctgatggccagaggatgaagcttcttctaccacgtcgtcccggggttcttccttcactcctttcagtgcgagatccttatcaggctcaacttaaaacggcatttgatgttgcccatttgtctaaatcacgaaagctcagctttgcctcaaggagtccgttgataattccaatcgtgtacatcctcattgcaactgtgggtagtaccacattccaattgggtgacaatttaacccatttactcctgttttaagctgcacttctggttttaacaatatccagagaaggaaagctatgtccatctgtcaatccatcatatattattcccctcaatatttcttgatgctgagagtgaggatcatagccttgttcctcatcacttccctgatggcctgaggttgaagcttctacaactttcattgtactgattgcatctaggaaaggcgttgtgtcgagtacatgtaggaaagatgtcaggagggactgcgttcggattccaattcgtccttagcctgcgtagatatctcctttataaatccaattagggaatacaattcctctaaacctttaccctgcaaatcctttcttttttcatactagtccactgattcaatgaacatccgcttaatcatttcgtgtagagataattccactattatctgtttccattcctgcttaggatctttcataggaactaatgccggtgacaacaacacgtttgaatacttggggtcgggacacgtgatttggacatctttcatgttcttcgctccttcgaattcttcagacacaaagactccccaacaacttagcgtcaaggtggacgtggcttcatatgaaacttgcactacaatccactcgtgctcgagaaacactgcctcaaggctaagccactcctcgtcactgaacaaaactcgtagatcacaaattaagacgtgatctgctgcaactctgaagttgtaatagcctttgtggtgaggaacacatcgagtgccattgataacaaggtgcaactcaacaagttcaggaagagaatactgtctcgctctcgcccttccacttacatcctggaagaccacgaatccagaaacgaagatcctctcctccattgccaatgaagtcaaaccattctgagatctcggtttggggcatcaccacttctaatccacatattattcctttcacggcctagcatacattatgtaagttaattcagaaaagaaaattaaaatagcccagatgatgtttacttgtttatgcatttctcatgttttacggatgtgtatggggtaattaactatttatctgtgtttaaatcagcttaccttgcatttgggtataaaactaagaaaaagtcaacaatacatgcattttgtgtgtacatgtgcgagtgcatgttggcgggtgtgtgtgggtggtaaaactaagaaaaagtcaacaaggagtaccttatgaagcatgatataaaagtaaaatatatttatatatcattttatgatagttcattgtcacttttatttaattaaattttatagaatttctgattattgttagtatgactaacaagaaaaaagggtgttttaaacaaaaaattatttgaagagcaggagtaataaacatgtaaaattacactattctagtctcatttatgttttcctcaactaaatgaaggaaatatgcatctgaacacattctctttccaagcactttcttttttctcgtaaaattgcgaaagtataaaaaagaaatgtgcatatatcattttcctaagataaaggtatagtatttagatatgaagcaatgaatggtgatatatacatgaaaccatagcttctctgatgtctctctagttaagttgaagcaatatcttgcatctactttttgaatagtagatggcaaccatgaaatttcctcaagattcccacattgatgaacattgagaattctcaagtcagtgcactcaggaatattttgaagctcccagcagccactcgatcatatcgagacttgtcaagtgattacattccttaatgcatgcagggatagatacaaaattgttctccgatgcagttaagtcttctaattttttaaagcaattgagaattgcgagaagatcttcatctgacaaaccaccctttccaaaatacagtgtccttaatgttggacgaacattggctgctgatgggccatgtacgaacttttgaaggattctcgaagttgaggacatcctccaattttaaaggcatcaacatttggcaacatgaataagctacttggtagatacttaagtttcctgttatttgatatgtctatacaagcaagcccagtaagattaccaatggattcttgcagtttttgaataacagtatttatcaaaaaaatattcaatggcttgttcatttgttgcattatctctgggaagtgttcaagcttacacttaaggtcaaggacttccagagaaggtagaaattaatattctttgcaggaaatttctgagtttggtgcattctgaaacgcttaaatgagaaagtcgttttagaaatccaacggttttatgaacagcaattaggtttctacaattatctagtctcagttcccttagattttgaactttagaaacatcatgcatttcggtgatagattggttatgtgaaaaattcatcttagtcagccatgaaaatctctgccagaaagaaaaggttagtacaatgattagcaacatgtttgggttatactattattttttaatgtgagtaacaatggaagcttttgttaaatgaaaaaataaaatgaagtagaaagaacaagaaaacattctacagaattgtaccttaaatggctcttccaacgttagatggcttctaggcaaattaaagacaatgatttccttcgggatgaaaaattttgatgggaaagactttgaaggatactcttcccgcagatgtttaggctcagatgaaaaagatgtgtttcgaacaatgagaattctgagccatttcattttctcaaaagcaaaaccactccaatctacttctgctcgctggggaggatcaagcattatcccctcaatcttgtcacttcctttaaaaacaattacaaacaagtaacgtcaaatgcatgttgtcattattacaatagactataatgtataatttataaaacaaaagatacatgattcttaccaaatcgatcatcagttagtatttcaataacatcaacataatgccatagtccgctacgttggccaggattttttggtgcctccttcctaacaatctctctacccatatcttgtattagatcatgcatcttcaagcagccatactcaatggtgagaagagatttattaacataataccatagtctgctaagtcatttatggatttgtccttttggaccggttttaactgttatttgaccggtttaaggtgtccttgacagactcagttaatatttaccccggaacgtgtcatatgttttttgtctcgtagatgatcgttggctttacgagcgattaagggtaattaatatttaccccagaacaggtagtgaagagaaaagaaaggaaagaaattgtgggttctaatttttcactaaaaaaacatatgaagtaaaaaaaaaaaaaaaaacatataacttttattcagtagcaaaagaaaaatagagggtaaacaacaggaaagttaagagcatgaccacaaggaatatccaaattaaacaccagcaaacaactgaaaatgaaagaaagcacaaattcaacacattctattaagtttaacactacccactttcttccttaatccctcactttcattggaatctgctaaaagtacatttattctggactaacatattcaaagatgatacactaatagctgtttccctgaaactcattcagcaactagattggaactttgtagagctggagaaccttgttccatgatggtctactgctaatgtcatcccaccaggcacccacatgcttcctctcctttaataaatactttttgtccatattgttcacaacataatcaagaaatggaaggtggctaatatcagcaatgctgaagaaatccccagccaaatacttagtctttgagagcctctcctcatagatgttcaacacttgcaccagctttgcttcactttcctcaatcaccttgggatctggagtcacaccaaatattgaaccaaacaaaccatgaagtcacaagttgtgggcttgtgggtgaaagttgtgtgcttcaacttctagccattgctccacaagacccctctcttctattgtttttcccagcaactcaaccccttgagatctgtatttttctgcataatacctcattatagcacgagattctgcagaaaaacatgaaaacactcaaattagagggtaccagtaacaaaaactgaaggaacaatcatagatcaacaaaattggttaagctattaatcatttgatcttttttaattttagttcagaaaactgttgagttttagtccctacacatacatacaagttaagttttgattctattgctaacagcctaacacccatgattttaaacagtgttttgcaaccacaattgcgaccgcaatgtcaaacgtatagtttaaaatcgtaatttaaaatcatgctaacaccataaaagaatttctaacgctaaaacgtatagttttcttacaaagactctaaaacttaaagagatataaaaagcaagtgaatagtttaaccaacaaactatatataagtagaaaagcagaacaaaggagcacaaagtgtaaccatataaggtataatctccatctttgatgacaggaacaactccaaatggctgcagatattatgaataaagaacatgaatgagaagataaagaattgaagacaaatcatattcaacaaaaaaaaaaaggaaaatagaagagttgaacctgtagtttgaggtactcaggatccttctgctcccccttattgacatcaacagggacaacttcaaattcgacttccttctcaaccagacaaaccagcacccgctttgtggaagcacagtggggaccgtatactttcactaccatgttttgattctcttgaaaaatggttcaaatcaagagtgaaatggaagagccacttatatagttatattactcaggtttgatcagcacatatatattattgtttagttagtgacccaaaacaacttatagctctacatgtcaagtggtcagtgaaagcagcaagcaaattaacaaatatcaagttgatgggtgggatcaaatctggggacaccacgttaaacaagagattaatatttaatatttattgtataattttaatcaattaattaatgttatgcgtaaacaactttaactttaactttagttaatagattaataaaaggtaaatggtaatcaatattttaaaaatattggttaaaaaattaaaataaaaatatttttattaaaaaaattgttatttataattttttttacaatttaaataataaacattttttctttaactttaactaatatcttagaaatatttatcaataacatatttgtataaataaatgatatcagaaatgcagcataggagaatcacttttcattagttaatagttattaagtggagaaagaaactcactggttgcttctggagagactcttgggtccttatcttttttgggctattagattataagatcatacgtcgtgatcttatttcctcccttgggtcaataattcaggtgcacttattttttcaaaatatttggttgtttggtcataagtatatatgtgtgtgtgtgtgtgtgtttcatttgggaagttttcctacgtgttcgtctttgctaacttacatatgtggtcttaaataagaatggaagtaactcatggtttccaccggttcacgctaaggagttaagttgatccttttgaaaaacagtacattggaacacgaatttgaattatgtaaaccccgtatgtacaaaaaggaaaaattatgtaaagaacctaaccaatggttattatcaagcctagttgcatatcttatttttcaaggttctcaattatattattttaatttttttatgttctaattgccctaattaagtcctcaactatttttaattctgcaatcaagtctctatcattaatctgctaaatataatatttttgctatattgcctaaacatatatattgatttgacattaacatgatgacgtaatgcttatgttacatgcaaaagtgagaaacaaatttagtaatggagatgagattcgaactatcacgccatcaaattgtgacaaccatcaagcactacattagtatgtctgtaacatgtcaatatgtgtgtcaacatctatcaatgtgacatcatgctaacttagcatatccatgtcatgttagcaaagtctgttaaacatgtaacgttgatggaggaatttgattgtaaaattgaagataatttagagactcaattaatataattaaaacctgagatattaagctagcacaatcctaatatctaacaaatcaaaaatataattaaatcttattttaaaagtaatagctaacaaaattgctattatagagcttttcagtggtttattattattattattaattattattattattattatttgctatattttttaaaattattatcttaagtatttatattttgttattaaacaagataacatgtttaaaataaacagcctcttctttttttaggtgaagatgatgatgtccagccgccattgaagaccagcagcccctggagccatcattgatgaccagccagccaccattgatgacttccagctatgcaccacctaccatgcagccatccttgacaattgctttccccattcacaccataatgcattctataaatagaggtgcaaacctcagttgtaatcatcaacgaaaaacaccagaacaccaagagtgaattcctccaagtagtgagaattcctagtgagtgtggtgtgggtttgagagtttgttttgtttgagtttgtaaatctctgtaattctattcttgtgagtaatagaagttatttttctctcaaattcgtgtgtaccaacacccaattgatccattggcctcaacaagtggtatcagagccaggttagaggtgttggtcgattttttcgttgatccgggttttctgagttttgcccgaaatccagttttgattgcaccattggattcgtctcgtcgaatcgagtccaacgcaacaaacggcgagttaaacggagttcaaacgagcccagaaatcgcagtcaaagtttggtcaactccgccggaagttacagttcgtcgccggagaagatgaccggagttactgttcatcgtcggagaagacgaccggagttatctttctaaaattgcggtttgaccccttatcttcctaaaatttcagtttgaccccttatctttctgaaatttcagtttgaccccttatctttctgaaattttattttgacccctagtttttctgaaatttgtgatttggtccctaaagttttgggaaattgctattttgcctcaatagtggaatattgaccgtgaagtgtcaattccatcattgttgaccgttccagacgcaacggtgagctccattttgtaagattcaaccttgttttggtgaattaagctactataaggtgataatgaccacagaagagtcaacatcatcttccggagccatgattatgcttattgctacaaattatacgctgtggagacctcggatggaagatctcctaagctataaagatttgttcgatcccatagaattgatgggtaaaaatcctaattctgctaaggagttggagtggaagaaatcaaatcgaaaaactattggtcagatccgtcaatggattgacaatagtgtcttccaccatgttgcacaggagacagacgcatatgccctctggaagaagttggaggacatgtaccaggccaagaccgctcggaataaagccctgttgatgaggcatttagtcaacatgaagttaaaagtggaacttcagttgccgagcataccagtgagttccagagcttggtcaaccagttgtcgtctgtagagatgccacttagcgaagaagttcaggcgctgttactactcaattcccttcccgatagttgggaaacgctggtagtatcactcagcaactcagcaccggatggcaaacttaccatgtctatggtaaaggatgctctatttaatgaagaggcaaggagaaatgacatgggcacagatcaagacccatgtccttgtcacagaaaaccgggggaggcaacaaaagagtagtaaaagcaaatggagaggcagaagcaagagcaggggcagatccactgatggcagaaaaccaacatacaagtgccatcattgtggaattgaagggcttatgaagaagaactgctacaagtggagggaagagcagacccagagcagttcgcagccgaagaacaagggtggagaaacattagttactattgttggagatgtagctttttgttctacctatgatgagacatgccttcacgtctcacgagaagacacagaatgggtggtagatactgcagcatcctaccacgtgactccccacaaggaatacttcacatcataccaagatggtgactttggagctgtgaagatggaaaattccaattcctctgggattgtaggaattggtgatgttctagtaaagacaagttctgggagcacaattaccttgaaggatgtccgccatgtgccagatcttcggctgaatctattgtcaggaatagctcttgacaaaaagggctatgatagtcacttcagtaaaggcacatggaagttgtcaagagtcgctatgatagtcgcccgaggacatatttgtggcacgactcatgtgaagatatgcactgacgttgcagaaaaatgatggcaccagagactcggtcacatgagtgagaaagggttgtctaccctaataaagaaggagcttatcaatgtagacaaggatgctgcactagatccttgcaattattgtctgtttggtaagcagcatagagtctcgtttaattcctcttcaatgagaagatcagagttattcagtctggtacactctgatgtttgcggtcccttagaggttgaatcacttggtggcaatcgatatttttctaatatttatcgatgatgcttctcggaaagtgtgggtgtatttcttgcggacgaaagaccaggtattcgattacttcaaattgtttcatgtcatgatagaacgtgaaacaggaaagaaattgaagtgtcttcgatccgacaatggaggtgaatactcttccaagcagttcaatgtctattgcagatcatatggcattcgacatgagaagacggtccctcgcacccctcaacacaacggtatagctgaaagaatgaaccgaacaatcatggaacgtgttcggagcatgctcagtatggctaagctgccaaagccattctggggagaagcagtcaaagccacctgttacttgatcaaccgatctccatcagtaccattagattttgaagttccggagaaactttggtctggaaaggatccatcatactctcacttaagagtatttggatgtttggcgtacgcacatgtatccaaggagctcaggcagaagctagatgcaaggaccactccatgtattttcataggctatggagatgaagaatttggatacaggttatgggatcctaaggagaaaaaggtaatcagaagtagggacgtggtgttccatgaaagccaggctatagaagatattgaaaaacccacaatatctcagaagccaaatgttgcagctcaggtgccagcaacagaaccattgataagaaatggtgatgcagtgccagaagacattccagaagtagaaaacaatgaggaagaagatggtgttgagcagggggagccacaacccgctctaccaaatgttccaggaccatcacaagactcagatgatggtggatctcctcatattctagaagttcgtagatctgaacgagatcggattccatccagaaggtatccagaatccgagtatcttctacttactgaagatggagaaccagagagtttccatgaagtagtatctcataaggataaaagaaaaaaaatggctgctagattctcttgtgaagaatcaaacttatgagatcgtagaacttccaaaagggaagaaggcactgaaaaataaatgggtgttcaagctgaagaaagatggcagcggaaaagtggtgaaatacaaggcacgacttgtagtcaaaggattccaacagaaaaaggggattgactttgacgagatattttcacccgtagtcaagatgacttcaatcatagtcatacttggattggtcgcaagtatgaacttggagcttgaacggatggattgtgaagacagtttttttttttttttttttacagagacttaaaggaataagtctacatggagcagccggaaggaggtttcaggagaaaacctcatatgcaagctaaagaaaaagcttgtacggtctgaagcaggcacctaggcagtggtacaagaagcttaactcgtgcatggtaagtcaatggtacaagaaaactgcagcagatgagtgtgtctacattcagaagtttaatgtatgcattggtgtgtacgaggccctatattgcttacgcagtggaaacggtgagttgttttctctccaatcccggaaaagagcattggaaggcggaaaaatggattctcaggtaccttaggggtacaatggagatatgtctttgttacgggggagttgatacattgtgacagtcagagtgctctagatttgagcaagaactcaatgtatctttcccgtacaaaacatattgatattcgctatcattggatacgcgaagtaatggatcgacaactgttgagactagtaaagatccatacaaagaagaatcctgcagacatgatgacgaaggtggtgactcgagagaagctagagttatgcagagacataactggaagctagagttatgcagagacataactgaaatgtttttcttcagatacggctggagggggagtattgatgatgtccagccgccattgaagaccagcagcccctggagccatcattgatgaccagccagccaccattgatgacttccagctatgcaccacctaccatgcagccatccttgacaattgctttccccattcacaccataatgcattctataaatagaggtgcaaacctcagttgtaatcatcaacgaaaaacaccagaacaccaagagtgaattcctccaagtagtgagaattcctagtgagtgtggtgtgggtttgagagtttgttttgtttgagtttgtaaatctctgtaattctattcttgtgagtaatagaagttatttttctctcaaattcgtgtgtaccaacacccaattgatccattggcctcaacagaagactcataatatgttaacctcttgtacatagttcaactctaatggaaagccattgttataactacagtataagacgagactccaactaaaaaaactaatactacatttattaattaattgggagagtctcatgacttatgtatataatactacattaaactttttttttactcggcagagaatcaaagtgatcaatgtctcacgtgtgtgagccatttggaaaaacattcgtcatatatattcttatatattgagtaagaaaaatagagggtaaacagatcgaatgctaagaacatgaccatgaggaatatccaaattccacacaagtacacaactgaaaataaaaaggagatcaaggaagtacaaatcaacacattccattccatgaggttgaacattacccactttcttccattcctaactttctttggaatttggtaaaagttcatttattcttctctatcatatatattcaatgatgatactgttgccattccatataacaacagatactaataattcagtttccatgaagtccattgaaaattagattggagccttgtagagctggagaaccttctttcatgatggtctattgctaatgtcatcccaccatgcactcacatgcttctctcctttatcaaataccctttctcccttttgttcacaacatactcaacaaaaggaaggtggctaatgtcagcaacgctgaagaaatctccagccaaatacttagtatttgacagcctctgatcatcataaatgttcaacacctgacccagctttgcttcactctcctcaatcaccttgggatctgaagtcactccaagcattgtagcaaacaatacatgaagagccaagttgtaggctggtgggtgaaagttgtgtgcttcaacttctaaccactgttccacaacctctcttctactgtcctccccatcaactctaccccttgagacctgtatttttctgcataaaactcattatagcacgagattctgcagaaacacatgaaagcactcaaattagcaggtaccatgtaagagtagaaccaaaattagttgaaccggagaaacaatattaatcatgaagcaaaaaaatatgagttcaaagtgtaaccatataaggtgtaatctccgtctttaatgacaggaacgcatccaaagggctgcagatattacgaataaagaacattataatcagaaaatacagaattaatcaaataataatcttgaagactctaatcatattcaacaagaacggaaggaaaatagatagatggaagagctgaacctgtaatttgaggaactcaggattcttcagtttccccttaaagatatcaacagggataacctcaaattcgttttccttctcttccagacaaactagcacccgtttgtggaagcacagctgggtccgtacaccttcactaccatggttaatttgtttctcttgaaaaatccttcaacaagagtgaattggaagagccacttattgttgcttagttacacttcttatagtgcctctaaatgtgaaatagtcaaacaaagtctacatcaacacaaacaaaacagaggttgatgggtgagatccggggacaccacgtgagaaagagggggatcaatgtttaattgatagggcatgcatgcattcaaaataagttttcctgcgtgttagtctttctaactcacacgtggtcttaaataaaagtggtagtaatcgactattactgactaaattggcaggaaattgatcaaaatgcattcgaaacactttttcattttgtttacaaacgcgctactacttaaacccttgaaaaggtagaacgtgcccgatgacaaaatagggaatgaagagaaattcagtttgataataacaatgtcttcatttcagcttttaattcttgttcttggatcttattttaggacattaattgaattgaaggtatcctctccaactcaagcactatatcttttagttatataaatttacatgtcaagtgataattcatattatttgagtcactattgtttagtatgctgaattaactcattcactggaaacatattatatatatatatatatatatatataaatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaatataatataaagaacttcaaccaagcctttgaataaaaaaaatcagatgggtctcttgaatcaattcatataaagtaaaaaatgattgtatttttacaaaatttaaaaaaaaaatgcaactcaaactgaaattaggtataaagatctcttgcagcaccactatttctgaaagaaatcttgtaattgtaaatgcactaggaaagaataatgatcttctctttattaaaatgggaaacattatagaatgaaccctcaaaagactggccaattgttattttaagtctttcaacataatttttttaaaaaatagacactttttcaccaaaaaaataatgtcacctttttatatccacgactaacaaatatcaatttattcacagaatgatcagcagctactcatgagcagaaatcatgaaagaaatctgactggacagatctaagcttcctaccgttcttatccaaaaccattcagttctatcactttcctcctgtgaatgaaaattttcctcactgcttacgcagggatgaaactatatatagttctatggtactgcaaaatttgtataatcaactgctgatacaaagcaaccagcatgctgaacgatgtttattcgtacttagtttccggaatattgaattacttctcatataagtgactacaacgggatgggatgaacatatacagatatcaaaatgacaccacagacagcaaatgagtctccgactatagctgagataatgtagtatcactttcttcaatctcatcaaattccactggtttcccacaaacaagcttcctgtaaatcaaatatcaaattataaggacatttataaattcatatattaagaatcaacaagttagaaataaaacaacacaatacagctatttcaaaataaaaacagaaattccccaacaaaataaaacaaaatttataaaagcagtggattagatgcaactagacatgccgaagaaatgggtattcctcaaccatttggaatgactttttatccttcaaatgtgttaaactcgacttctatggtcaacaaaaatcaaccattactaacatccagcacattatatatatggaaagcataacatgcaccaactgaaattgtcatttgcaccaaaaaaaaaaaaaaaaactgaaattgtcatttttgtcatggttaacagaaattttacaagtttaaagattttttcttctttttgctcctttaatccttcttatcaggtaaacagatgacaatcaattgttaactagagatacctttgagatataaaattctcctcacacagtgccttatccagcctctcttcaaatggggttgcatgccattttactttctggtcctagggacaatgagcactaatcagaagctgtagatagatttagaaaccttataacaaataatgataatgattacaagccatacctccttgtacttagttgttgaattcgggatgccattgccataccaccacttgaatgacataggcgaatgctcctcgatggttgacacaggacttattctagcagacaaatttgaattgacctcatcatcattttcatttgaaaatttcttggaccctttttctggggtaggagtttcattttgagctttctcaaccaaatcactcagctcacttgaatcttcttcaaggttaaaatctctctccttgagtattttgcaccagaagacattatcacctggttcgttagttggatagacaaactgggaccgaacttgagccttacccgtacgtaactcttctaatgatgcagggtacacagttcctggtgtttgcatctcgtcaaataacttcaatggggtaggataaggagatggtttatgcgcactttggctatttggtgacttgttttccttaatatgccaatcatctgatgagcttccataggttgccaagtcagtttcactttcaaaacgaacagacttgttctttctctgagtatatgtggctagcaaaggtgaaaccaaagctgcattcctttcagacctatctgccgcatgaaggttccctgaccaatttttttccatatagtcaacagagtcatcttcagtatcttgtgctttggagatacagctgcaaaagaaatgaaattaacatctgatcaggttctagtcctccatccaatataattatcaatggacaattctaagttccaaccaacaatcatacaattaagtaattatctaaaatccaaaatatgaaagaaaggatgcaggaaccatttgaagggcactttttttaaagcagaacgaattgtctgattctatattatagttaaaatgcagttgctataccaggagctctaactattgagaatgtatctaaagcttactataaaaattgagtaaaaatcgaagattcacctaccatgcaaattgactaaaatatcagttgttcaaattcattatcattcaatatcagcattgacaaaaannnnnnnnnnaaaaaaagagtcatgaataacctgcttggcatgtgctcaaatgaatccatgctatttcccaatttttggcaaagatttatgggtgttggtggatcaaatggttggacatccagctgcagtttctccacagacgtgttaggaagccaagaatgaaatcttgaagggtctgaatctttatcaggagcaggtgatttcaacttctcagatgctttacgaatttcaacaggtgttcctgctaaggtcccacaagctttaagaaacttagcctgtagaaagagtttatataatgagatcatcaaaattcaattgacaataacaaaatgaatacaatccataaaaaatgcaagaagaaaaaaaaaaaaaaaaaaacaaattctatgagtaacttgaaagtatttgaaatttgatatttaccatggtgcaagtataatcctctaggcattggatacaaaacaggtataacatgaggacacagcagatcatgaaagagtgatagatgactgacttttcacaagccaaaattgaaaaaagctaactaatggtcctaattgtggtcattattcaattgtttccagtatgttttacagaaaaggtttatgaaatcactctattgctttccatgttttttctttatactacattcatgaaggttcgtaaaatttacaatccaaaactgtccaagaacaactaagaaacctatactatgtcagtttgcagattccattttgcccagcttaacgccaattcacaagatgaaaattgaaccttattttactcaatgccctaactagttcaaacaaaaaatacaaaaattaaaacaaccaaacacctgagaaaaaccattaaaaaaaccatttcggctgcagtaatagtgcaataccaatattaatagcactatgaaaatacctcatccttaagcccctggaagtccccctcaaacccaacaccatcaatcctcgcagaatcatctctctcttctaaaaaggttatatcacaaaattagaaaaataaaaaagaaaatgtaaaagccaaaagaaagaaaacgaagaaacaaagaaaagtaccttcagataataaagaagacgagcgatttcgagataccacaacaccctgggtttccacacagcgaaaattctaattactattaaaatataaataaagtaattcgtgaaaacagcaaagacaaatgcgaaatgttacggtggatcgagtggaggagataatcaattgtgatgtgtttatgcggcgattgtctctgatcctgaagcacgcgaagaagcagcccatcgctttggtgaaggatcggaagaagaaacggatcatgaaccctaacacgctcctcagcatatcagggaattcagaaaccctaacttggaattcaattgagaatcgagagacagagagagagagagagagaagtgtgtgtgcgcagtgaggtgccttcgtccctgaagagtcgaatttgaattttgaagcggctcccagcgagggaaattaaattagaattattaatagaatatatattcatgatatcttctaacatactaataagtcagatattaattcgatgcatgcatgtcgctgacagatggatttttttttttcttctaacatactaagtcagaaaccttataaagggagtttaaattttttcttcttcttttataaacgtctaacttttaataaataatgatttttaaaaaattactatttttagtcataaaattaaaactaattattaaataatgataacattaattattatcctaacaacaacaaatatacaattagttttacacaattttatattaattattactttaatcattacaataaaataacaaacacaattaattttacaaattttatactaataaatattaatcgttattataataataacttacaaaattaattttatactaattatcttttatatatatatatatatatatatatatatatatatacattaaatgttccaagagagaagggaccctccagatcttgttggtccccctctaacacaagttctctattaaaatatattgtttttccatatgtaaatgtagtgaattatatattattgacttagtatcacttttgattcattgtgttttgtatttattttattttaatatattaagttttgaaagttttactttggtcctttaaatttttaaagtatctcattttgatcaattctttcgatttttattagaaacattaatattatgttaactttaaaattttgaaataatttaatatagtgacaactaaaaatcaccattatctttattttatttcaaaaatttaaaccacaacaaaagaaaataggtgaaagtattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaccataagttatgacacccaataaaaataaggtttcacataacattaaatgacaaagacctatttaaatattctatgcattaaattataaaataacaactttgaccactattccctgatccgtaagaagattacagtcaaaaatatcctccttcaattccatgctcattaatttgttgtagttcaagtattctggtttaacttgttactagatatatgtctttctacaatttagtccacgaaagtctaaagtcactccctttttaatttctaaatgtattttttgtgttaatttaatcctaaatttaatgaaatgacaaaaaagttagtaatttaggactaataagagagtaacttagaacttttgaaaactaaattttacgaatattaaattagtatttttattctatcattgacatattgaattggtaatatttgtttaccattgatatataaatacataatttttattattttcctatagtgttaacaaaatcatataagaaacaatttagagttttgttaaataataataatttaaataaaccaatccatttgtcataaaagaattttatttggtcttccttattttatttttttcatttaagaattttcaaattagtaaccttaatttcttcattcaaaatttcaaaattcgtgtctaaaactgaggaaaacatcatagatgaaacattttccacctgctctatccaatgccattgaagaatgaaagaatatttgagcatttagaaccctcatagaaatagttacgggaaacacatgcttcaacatgaagaaaggttgcaggcttagattagaggtcagctttgactgaagtatttaacttgccgggagaacatatcagtgccaccacagtccacagggtatgtaccaacaattccttccatatttttacttttactttttcttttgccctttggctgtggactttttaaaacatttccttggttgtaaaacgatttcttatttttattaatttgttgaatatactgtattttaatttaatgattttttgctgtcaaaaaaatatttaattcagattttaggattaatattttaatatatatttagtaatacacacacatatatatatatatatatatatgagttatgattttattttcataatctttatttgttaaaattattaaaaatataaattaatattaatagtgaaataatttaaataataataattttttaagttaaaatatatatttaattcttattttttttagatctttgttatttattttgatatattatttgaattaaaatataatatataatttatttaaaaatatacaagttaattaaaattaaaaaaatgcaggatgagctaatctatgaattttctcaaacttgataaaatttccttaatcaaatatgaattgatcatctcaagaaaagactaaagttcaaatctaattaataatgaaaaatacatggttgaaaagagatatctcaataaaaataatcaataaaattaatgaatactattataccattattttgttggaaaaaaaatgataaaattcaataaagatgacaaggttgtgttttaattttaacatataaagaagataataattttgagacttttgttcaaacctaggagtaaaaacaacaagatattaatgcatggaagactaatattggagaacatgaaattaaaagaaattagttattaaaagattaaaaaaatggtattattttagtttcctttatacaaagctaggaatgaggtttttcccatggatgaaatgtgtagaattatgaatgcagtccatgaagcaaagttgaggtttcctgatttggacaggtgataggcattgatgaaagacagatacttcattatactccacgtttccatatctacaacaaagccacctgaaaaatgccacattgccgcgattccgtccttgcattctttgtcgcagtttggtcgtcagttttcacacattggttgctttccgaggcggttttacatagatcctgccgtggttcaaaaactttcataactaccagagaaatcttcaacctctcatcgcaacaaaatcttcagaggaatcaaagaatcttcaaaccttcctaccagttgctggaaccaccatttgtgtctacatttttccaaggtattttaacttattcctaatttttaaaactttgttggttcaattttccataatcttggtcatctgtgtctacattttcttataccttagacctagagtgcttttggatgagaaatttgaagagtgtaattcatttttctagcgaatttcaattgctgtatagtaaaatactttgcttggatagtgtgttcagaaataatttaacagtctaatattttgtacggacgaccttcacagaaatttaatatcttaacattcgtggcattcagaaaattatagtgtttgttaaacttggagcaaataataggagtgatctaattggtattacaaattttgctctctgggttttctattttaaaaatatatctttctttcacctttagcattttgaacaaatttggtggaggatgtgtttcaacagcacagtgacacagtcctcgcctcaaagatcttgatttggaatctaggaaagcagaagaagttggtactttcccattagttttctgggattccatcaaaattcagttttggaattgtagataataataatgtgtaaaaattcatcttttaacgtgaagtgtttgtttatcattttttttgtgtgtctatggtggttgctttgactgaagtttgattagtttcaatttgttctcaaagaaaaggtatctggatttttatcagttatcctgaaatagcttattggtgacttgttggtcatgagtttgaatccggaaatagcctatttgcatatgcaagggtaaggctgcatacaatatctcatcctttacctgcgcatagcgtgaagcctccggacaatggggtatgtagttttttttagtttttttaatcctgaaatagaaaaatctttaccatgcagcatgatatgaagcagcggggtggttgagaaaaatggttggaattgttgcagctaaagatttgccagcagagccctcagggctaagaggaagagtttaggcttggtttgagaagtgggattattctctgtattgttattaattaagttcaatcgggaactgtatccaaggtgagttagatcataatttagtttaatttgcaattttactggctcaggttttggttattccgtcattgtatgttacaatgtattcttttaaggttgcggagagtcctgttgattctgcattgatccctgatgcggcaccattaaaggcatatcagtattttgaaagtaaatagtataagtaaagcattagatacttgtttactgttttcatttaagtaaccaattcatatcatggtgaattcaattgttaataacaccaggtagtcagcacttaattgcagactcttgatagtttaataatgtgttgttgttttggtttctactttctactgagttattggttatattttagggaggaaaatcatctaggattgtccattgcatcctggcaatgaaacactatagtgaatgaaaaatgacatgggcaaatggtgtgtagaaatttggcagaaatctcaaatccattgtctctgcaatgaggaaaaactcagccatttactaattccttattatggaattcatcgaacaatgataaatgccccactgctcttaatctgacattgagtctaataaaatggtaggaaaacttggtttatttgcttagcaaaaaaaatgaaaacttggtttattttgacttttatacctgctttggacttgtctagttgaacagaaagagtaagtgatgaaatattttattttgttagttgcagtgcggttcccattctttgagtatgcttgtacatgcaattctatcagataagaagcagaagaagtttcaatggtatgggaatatgtagctctgtgtttcacagctgaatttcatcacaactttaataatcaagattcaagttacaccttatagattataacttataagtctgttacattacttgaaactctctgtctctattatgataaaaagcttttgaaaattgtagcattatcatgaaagttggtatgagcttgtttcctcgctgcttaaattaatgggtctaagaatttttttaattgatgtcatgtgccccttgcttatgatttgatctgcatcacaaaatgtcaaagatcagttctaccattctttcaaatcttggctctagtttttctttctttatttatgatgtcaagtcattgtctaattacgaaaaacaagacaacagaaatagcttatatagtgttgattactaactaaattaagatcgttgatataatatagtttagcagatttaaaagtgataaagcttagcagagagatcgttcgaccacagagagaggtcatcctccagacttagacaatcctttattcctgttcaaaccagaccaatttatcctatagttggaaactcaggaccaggaggaccaaactttcggcagttggaccaattaagaatgttatcaatttgttttaaatattaggatgcaatcattattctagtacactttggctctatttataagtacaacactaaaaacttaagtgatgttagtgtaacatttttttctttgttctcagattaagcacgctttctgctcttctagcattcattcatgatgatgaaccaagaaagactggaatccaaagccaggagtaaactcttttggaagttcaagaaggaacacaaagctatgggcaacaaatttgtactacttgaaaatgaaaatgtttctccggtaaaaattgtgacacaaccagctcttggaaaaatcaatgtgatggaattgattgagaaattcaacactcaatctgatgagtttatatcaaagaaagcatcacgactttgatttgtactaatgacttgaactctgcttcaagtagcacaaagatatttgcctgcgtatgatatgatacattattacataaaatagacaacaattcttgccgtataaatttcttgattactatgtaacaccacaatttccttcctaacatgcataacataaaaagtacgagcataagccactaacttgaaccctagtggtaaaggagtttagcgaataggttaaaaacttttagattgttattgtaccgaagaagataaaaaggagaacaaacagatctaatatgtgtactgaattctcacttaattaattcaaatgttgaagaattagataagaatggttcttaagtctcgtctcaatgaattgcagaaacttgaagatagattgttaatcagaaggctcgtgatttgggtttttgcttcttattgttgtcactagtccttatcatttatgagaatctaaaaatagacaaaacctgtttgctttatgataaagtcatgagttagagttaagccaaaattccaaaattccttctaggggaatagcagagaatataaaataaataaaaaatgtacggatcaacagcaatgcacgcacggattacttactagtttctgattataattatatttactattcttgtgcttaattagtttattccagaacttgaacaatcgtttgtatttgtggaaaataatttttttcttcattatcagtcttctacgctgaattagaaagatggatatatatatatatatatatatatatatatatatattttgtaagttttttacttttcggaaacaactgtcttcggttctttatatcaactacatatgtataaagacctaaacttaaaagtgacatcacccaggagtcactccagataaaagttttgagtgacctcatattgtcacgtatgaattattgaggatcaaagcaaacatataaaacgagaaggaacgtagaagaaaattcatgcttgtatttctaatttcttgttatcgtatgtataaaaagaagaatacttcaaattagaattaattggttcaggaaaaatatgcaaacaataccatcatcatatgcaaattgttgggctgtagatttaattttatgacaaaatgtcttttacaaaggtagaaatcaatatttggaaggtttaaatacatttgcattttttttcattttcttccccacaattttttttattttattttaatctttgcaaaatatttatttttgtacttaaagcattttagataatatttttttcattaacactatctaaaatatttttaaagatgagaaacaaaataaacatattttacaaggactaaaaagaagaaaaaaaattatataaaaaaaatgttaaattataataacaaaaagtatatttaactctgtttgaaaagggttattacttttgaaaatatttagaactagacagtgattttggtggatcttattcttttttgttaaagttagctttcgaaaattctctaaaaaaattatgtctttgaaatctcttttgactttttcccttcttaattgcaaatatctgttccattccaatccatatatgtatgtaatagtcaaagttgtgcccactcttgtagactttactccgttgttgccctcaaagctaacatcgattcaaaattcttgtcattggcatttcaccttcctcgattaattaacatttgtcctttggaggcccctaaataaattgatatgtatcatcaggtcaaaaacttgtaagctttaattttatttttaagacacacacacacacacatatatatatatgcacttcataatggaaatatttgacttgactccagcagccaaagttcaatttacacaatgaggtcacaaatattaatataaatacatgggaaggaggaaaataataatttacacgttataagaaggttcccaagttttcaagtgttgcacacagactaataatggatgtggccaagttacataactctgatgatgatgatgatgagaaaaaagaagaagttgtgcttcctgggtttagattccatccaacagatgaagagcttgtggggttttatctgagacgaaaggtggagaagaagcctctgagaattgaactcatcaaacagattgacatctacaaatatgatccatgggatcttccaagtaagatcagcttcctctttaacatatggtatcagtcactgaaagtgaaacctattttttgtttctgctgcagcagataaatttcatgagtttggttatgattcttgatatatataattcaataattaaggactagagtgtttgatatatatataaattgaatgaaacaagctaggataattaattaagcttaactaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatattgtgttggagaagtgtatgtatagataaacttaactagcacatcttaattattaattatatggataacaaaagactaattaaatggctcaattgatacttgacattttgcgaagttttcatgtgaagatgtagaaactcgggcttcaataatatgttattggataaaatataaattgaaaatgaagacatagttggtgtatatacgcatgatatgtacatgtagctggttttcaattctaggctagctagttaggtgtgcaactagctagccaccccattttgattttatatatttattgtatggattatttcatgctttctaatctcaagtaattttttgtatatatgctgataactaattaatgtatgaagaagtgagttcagtgggggaaaaggaatggtacttcttttgcaaaagagggagaaaatacaggaacagcataaggcctaatagagtgacaggttctggattttggaaagccacaggaattgacaagcctatatactgtgttaaagaaccccatgaatgcattggtctaaagaaatcattggtctactatcgtggaagtgctggtaaaggcaccaaaactgattggatgatgcacgagtttcgcctcccacccaatggaaaaactagcaataatccacaagctaatgatgttcaagaagctgtaagtcaattatatatgttactctttgtttcgttaatatctatgcatcgttagcctacaaaattttacatatataattaaccaatctgatcatcataactaataaatgacttttacaatactttataaaaatcaataatttaccatatataataataatttataattgaatgatacattataaaaaatctttacataagtgcatacactattttttataatctaatatgacagtacgtttgaaatttcttttttatgttgcatgtatttaaaagaagtataaaatattaatatgtaatgggaaataaaccatctagaaccgcatgtaaagaaaaatctgagataaaatagtcaaacgaccacaacagtttctgagattcggggttagaatcttgttcatactcagaagaccactaacaaacaattgtacttataaattatattctaatgtcataagcacgtttattagaccctaaaagggagaaatgcatatagataaagacacatgaaccaatttatttattaaataatcacatcaactcttctaggctgaaataatttagcaaagaaggacagacactttcaaataataattgtgttgtactgtagctgtatacgtaaccatgtcgaatattgtattaatatttttaattaattgtaatattgtattttttataattttttcaaacttgtctacttaccacaacaattagatgattttttgtattttatattttattatgttcataatgatttgtatacatttttaaaacatgaattttttttctcgtgatttaaatcattactttatattaactttatattaatttacatactatattatagctgcaacgttttctgtaattttcaaattttgttatgttatgtattttatgcatatcccgaattgtatctatacttcctagtagttaattagccttccttatgatttgtagacctaaacttaaaattaaggtagttacttcacttaatattttgttactaaaaaatatttataaataatcttgggtctcaaacttctagcacacatggcatgtacaaatgcatgaaatacccagaaattttggctccactgcctatatatatgtcaggatacgggtgttgcactttcttgtacagcaaattaagtttatactatttgcctattagctaaaaaaattaaaatatatgttatgtatgcttggaatatcttgttttataattaatatattacaatgaagttttagttaagctaaaatccctaagctttcatttatagaattaaataaatacaattaacatattaaaattcataacatatatgttggttcctatatatattcagtctagtctaatttgtgtttgatgacacgtttcttaggtcattggctcgtcaagctcttttgaattgaccgaatgggatttaatagtaattaaataaaggagaaaacaatgaagttaatagtaaactatcatttaaccatataacttaaattaataaaaaatgtaagataaaaaaaaaattgtagaaaaattaatgatcgtgtaaaaacctttatttattttttgacagggtaaaaacctttattatgaactagtgaactacatatcaaattaattatttttagaagtactatatacatgtatctgttttagaaccatctttgtgtgttctagaatcgttttaaaagaccttttttttgtagtagtgatatcaaattaataatttgcattgttggtttccagttcaattatactaaagcattgatggacaaaacgaaaaaataaaaagtagtagtacctaacattgtgctattaatatacttaacgatggtttacgtaacaagaaatctcgcaactaattaaatagtgtatacacttcgacaattttgtgtggttctcatctcagcgttacataaattgcatttatttcattttgtggcatttatttcattttgtggcatcacttaatgcgatcaaccatgtcaactctagcattctgtacctcttttgtttgcaagtttttaagtgtcttaattttttttatgtctttttatttatggggttcgcaggaagtgtggacgctatgccgaatattcaaacgagtcccaacttacaagaagtacacaccaaatttgaaagactcggcagcaccaatcactgagccaaatcaccccacaaactcttcaagttccaaaacatgcagcttagaatctgacaactgcaagccatacttgactttcacaaactcatcatccccacaactcattcaacaaaatgaaaagaaaccagttattaatggacatgttgacgttgaacctaaccacttatttctaggtcaattaggcaatgtagctcaggctccaacatccttggcttactcaagtttttggaatcatcatcagaataataatgtggaatttgctaatgagaattgggatgatctcacatctgtggttcagtttgctattgatccatccagggtttctgatcattgtaaagaattcaatagattttaagagcattttgatgcttaaactactaataacagtaacatagttttaatattaatatctctcagtttgaccaaataggagtattttgttattttttctttggccctcttgacaaaatatattattgtatcaacgggttatagttttgatagtatttgtcatgtatatggtaccctctattttttttatatcaatctcattaggggacaattcttgttcctttttatttgtgtgtctaaatataattaacaaagcattgattatttgatttaattaactttacccgtcgtgtataataacagctgacagtagacattaataaagtgatgttttaaatatttcaatcaagacataggagtttagcttaattatttgatttgaattattataaattttttatacctgtttttgttttgtatcgagaaaaaaaaaacttcaatcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattatgtatagttaaatgattgaataaaagaagttaaaaaagcttaaaataatatatatatatatatatttaaaaacaaataaaatccttataaatataatatcacattatataaaatattatctattaaatcaaaagatttcaaaaaacttatattttttaagataatatacgacatatttttttaaaataatgctgagactgggggactaagagaggggaagactccaaaagcccacaattcacaaaccagagatcatagaattaaaaataaacagcttataccaaaaaacatgagggaccaaaccaacccatgacagagattaccaaaaattaaattcctcgatgaaacctataggaagttttacaagagttgtttctatagagatcatctaaaataaaagaaggggaaaaatcccaccaacaaaaaatagaactatacacttcgaaggccgttaacttacctgcataagtgttgtcttctctaaaaatatgggagatgcgaaaattcatcttagaagtcacatataattatatatgcagtttctccatctatgaccaagttaagagacttgaaagcaagagtttccaaagtcgaatcacattctaaccaaaggaaattccaccctttatcatgcgcaagctcaatggctctcatggctgccagcaactaggaatgatgggaggaggacaccccatagaactcaacaaaagcaccaatgaacataccaagggagttcctaaaaacagcaccatcagccgcccttcctgggctgaatatacgacataaaattgggttgaaataacacaagataacacaaacttgtcctcaaaattcattgggtctaatttaacttttttggatacgttaagatagaacaaaacaaaatcttcgttatatttcatttcactcaaattaaataaataaataaataaataacgatataaaaatgtaataaaattcactcactttcataatatttcttccacattttaccaattcaaacgatatccttatatttcattttcatctagacgcatacataacttcgacgtcaacacttataacaacgctccgataaattcgggttggaaatgggaagtgatgtgaaacacttagcaatcccatcaatgctgtcttttttttttttttttttgtggaaacaaaatagctgttaatacaatagttatcccagtaaagggcataacttgaggaggaggtgaaaagagggagtgtcaggttgcaatgattctaaagaaagtcacgcactaaagtactacatcaagttattcgtaaaacatttgtgggctttttactagtcaattcttcaatatttatgatactccatcccatgggactcggaaaagctcagttgtttaattgttgaaggtcctcaattcattgtggataaaaaaaagggctttattcgttgattaaatgttacatatcacagatgatttaccggacagctcgtgttgtattacattatatttacatcagaaaaaaggtattcacttttcagggcaggtcataacacagctttgattaggcaatgataaaatgaaaacaatatggtttacacgctcatccaacaaaatggtataattacattgcctaaagttgaaatttgctctatgttgtatacttgtgaataacatatcagggttgatggaaagagttagctccttgttcatggtggtgattggttcctggctggctaaccacaggaatatccaagctgcttccatcagtttcaggagctacttcccttacatcagctatcctcgcctctgtagcctgaatatcactccattcattatctccaactggttgaatgttcacctgatctgttgccatgtggactacattctctgcagggacggggatggctctagaaacactcaggcatgctttatccacattctcttctgtggggtcaacatgctttgtatctgagcatgactctgtcttctcaaaaacttgagttgtatcaatgtgttgcctgttgtaaagaaaaatagctgctgtcaactttggttttatgatgctccacatttcatactgatatatatattcaaactcaatgaactcataaaaaggcaaataaaccatcaaaagtctccttccatttccctgtttcactaggtattgatatatactatttccatctttatgtttatgtgggaaaacagaagtagccaacaaatctaatttaacaaaacaaaaagcaagggcagaagaaaataaggcattagacatttagacctttgaagttgggcttttagtacattcacatatgcaagaagctcttccttctcttttaacgctgtggattctctctgaacagcctcccttatcctagtttcagcatttgcttctgcaaccctaaccttttcttctgctcttactacagctgcttctaagatcacatcatgctctctagcttttgcaagttcagaacgccacatatttgcttcctgaatagcagcatctctctgcctgattaattgctctctttctttgcttaagcccacaatcttttcttcagactctttcagctaccaaaaaaacaatttaagacaagatgaacattcaagacaatttcattgcaagtaatacccatacatagtaatagctaagggtcaattgtcgaacgcagtttaacgagaatcacttgaatttccatcagccaaaaaatattttcaaatgaaccagcacaatggcataccttctgtgtaaacagctcttgctgcttctcagaatctttattcaaacgctcaatttctgcacaagcaattctccgatgctcatccatagtataagcagcagatgctgcagcctcagcagcttcagcagtctcagagagtttatctgctatatcttttatagttgaatcacgtgcccgaaggtctcgagacaaattctgtagctcctcatccttcactctaagtgtttcctgtagagtggagtagcatcttcagaaccaaaaggcccaagaagacaataaataccgacataaaaacattaaaaaacaaatccattctctatttatatccaccatcctcatttcctcttcaaaatcttggccactacgccccctccccctttaatagatactacaagaggaaaaagtgatattccccaatatactttcttccttttttttgctttcatttctttttctaagcaagtgaacataaatcaaaagtctgcaaacgttagttagccaagtaaacagtgatgaaaagggtagtcctcccctaaccccaaaatcaaaggagtaattcatgcattttcaaacaacaccatgacaaggaaagacaaatttctttgtttaatacatgacaatggcgtacaaagaagccttatcataattcaatttcaaccatattgtgtattttgccacaaccattattgaatgcattatatacaaagtacgacaattagttcaaagcatcacacaatcaaaattcataaaaagaaaattaaaatgttatagctagtaactatctagttaagggtgcatttggttaagctttgacaaaaatataaaaaaaacacacttttctgatatcacttttctttttaccttctaacaatagtactaaaaaaaattcctcagagttttagcttattataaaaagtttaattaaactttttatcactgtacatgacacacatgtttaatctagtccttgcacaaaaagaaaaggtttccaaatcagtccttgtatataaaaggctacccaaaaaaaatagtagctataactctgcagttctctgctgcaccatcacaaatgctgaactatacatttgagcacaagaaagacagaataaaccagaactagattgtaccttcatgattgttaaatcatccataggaccatcagtagtattatttttcatcattcccagagcatttcgcaaagaaatctgcattgccgcttcaatttcttttgaacattccaaggctgtcgaattggctgcagcaacaactgttgcaacagttcctaattttgtagacccattcccacttaaggaattcacagcttctttatgcgcttttagaaccaactgagttgcactaatgtcagatgataaaataaatcagacatcaaaataattacagctattagacaggaaatctgaaatagaaatgatccagcaatcattcaaattgattcactgtagcggaaagcaagaacatcagacaaataataattatagtaaataataacaaaagtaacataaatataaaggctgaattatgacatgacattagtattctgcaggtctccctttccaagcaaatgcctattcaaatgaatataaaaacacactgttcaaaagagttagaaaattgtgaaggactgcagttatgacttataaatcctcaataatttgaaacatgacaaagtaaacaaagttttgtaagataatagaaaataaatgataaaactcaaaacaaatgcattagtacatttaggttcaagcatgcagtatttcatttgtaagctacacctctttatacacttttgaaatacaaagggattataacattcatactcatacattcgacaacataaaataaaataaaaaggataagattatattccttggaacttgccccagagggaaatgggagataaaagtgtgggattatattggaaaaaacccaagtcccacatcagtcagagatagtgccaaaatataatatataagtgaggggaaaccctcatcccatgaactaacttttggggttgagttaagtccaaactcatattctaagatgtcctagatccattaaaaggtttatccaccatgttacctacacaccaagtccaaaagtgctaagcgtgagggggtgtagggaaaaacccaagtctcacattggtcaaagatagtgtcaaaatataacatataagtgaggggcaatcctcacaccatgagctaactttttgggttgaattaggttcaaacctatattctaagattataaaacttactgtaaagttgacacccatgctctagctacaccaggagtctccgcacagaggaagtaatcctttttctgtggtgtcccaatatctaaagaagccaattaaggtaacaagcagagtgacttccatcaatttgctgcaacatgatgattcataagtagtaaatgcgataaaaaggatacaaaagcagcacccatcgtactttggaagcccgctgtaatacacagaagtaaataaacaaccatgtcaatataagaaaattcatgcaacaaaacttcataaaaacatctggaaactagacaaaataggcttatgttaaaaacaccattcttactggaaattcacaggagatatggtgatggtgctattggcatcaaatataatcgttcctttaacagaaggttcatttcgtcttatcctaaggaaaggaaaacattcaaaacaatacagaagatcagtaatcaaagtgattttccgtttccccacacaaacagaaaccaatatgcaaacacatacttgtattccattctccccgttgtcgggtccaagatgacccaacgctcgttccattttctcagctgtgaacacaaaagcgattcttacatgaactagctttttttctttttctttctaaaagcatcaatcaataatatttggctattcaaacgattataaaacacgtaacaaaacagaacgcattggaattataacagaacatcgaataagaaattaaaaattggaattgggaaaagaaaaggagtaaaggcgaaaataaagtgaaattgaagtgagaaataggaaataggaattgagataaagggagtgaatgaattacggtttcagatctcttgagaagtggtccttgcaacaggtttctaccggaagcggaagcgagctggcgcttgatcttctccaagctattctcggtgttttctgcagctcgctgtgtcattgcaaattcagctcagtgttattaacagcgattcaaaaatacacaacacgcaacgagagtgagaaagagaaggtggcgattgatgagttaccggagaagccatgagcgtagatcaagactttgtcggaagctcaaacacaaagggttttgggtgatattcccccagatttgcgtttacgagtgtttgttttttactttttacaagaaaatattgaaagaagaaaaaaaaaaagtttaggaaattaaattatttaatgggaaagaccggtaggttattatttggcatactgacttgcagttgtgcagttagcttcacttttttctgtgttggtcaggattaataattttaataaaattaattttgaataatgaaatacaattaagaatgcatatttaaatttattttgtgaatttaattagaatgataccacagtgtaaatatttattatgcttatcatcgtctgttgtgtataattaaaattgttgatttttataataattattttgtaattttacttaaaatgatttataatcagtttataatttaaaaattaaaaaataaaaaaaaaagtttataatgtaaaaagcctttaacaaagagtgtattaaaattaaacactaattttatattaaaaaaacatgattttaagttttttaaacattttcaatgtatatagttacactattaattaaagtaagagtttgcattgataatatcaagaattttacatcacttgacacgtacttcttgttctcagtttggctttctattaataatacatcacttggcttataaaaaaaaatataaagatttttatatcatcaataaactagtattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatagttttaaacatataaagtatattttaaatttgtaataaataatttatactgtgatatagaaatattttgaattattgataatttttataaaaaattgaaatttaatttaaaaataaaaacaacaataatattttgaaacaaataagatgttaaaaataattcttaaaaacatttttattgaagaaaaacttctagaaacactttcgaagaatttgaagaatagatcttccacccatccccttcactttccaccaaccaaacaaagtgtatttttgttttggtaaaattaaactttaggagaaggaaaatgatgttttggtacaagacacaaaaagttttgtgcaaaaatagagaaagagagaagggagaaaaaaaaaaggccatacaccttttaatgaataaacaatcaatttagttttaaaaatattactaacattaaggaaactaatttgaagaaatgttcaatactaaaggaactatatagcatgattttcaatgctactctaatctgatctatatgacacggtaggaacaagctcacttgggaaaacaagcgtccaacagcttttcagattattttttaatgctaaacaatgtttgtgtgattggactcaaacaaaaggtttcaataattatgctaatacaaattaaaagactattttttaatgctaaacaatatttgtgtgattcgtcaaatgcaacaacattaatgccgccttccatgtagatattaatagcactagttggggcatttgttgtagaggcaaccaaggcaatttcaaagttgcgatttttgacagtgaaggtcagttctttcctattgctgaaagggaggccttggggtcattgaaagcccgcaaatgattattggagaatcacttttgtagagtgatttttgaaatggatagtaagctagttgtagataagatctatagtatgacccaagatttttttgagctgtttcattattcaagagtgcgcatacatactcaccctcaatccaaactatttgatgtagtttatcaagaggcaaacagactttgtcactcattccattgcaagggtggcaaccgattatgctagtctcacaagttttgaaagtatagatcaattacctttttgtattcaacaggtgatcatcaatggaagttcttaagtttgcttttgcaaaaaaaagggagtacttgtatttaaacactatttaagagagaggatgatgcttcaaaaacaaagtaaatggtttattttgcttttttattttcttacttaatgagtgagatttttaacgatataaataccttattctcgatataattgatttacttttgttcataattcacaatagacttgttttggttttgagtgagaccaagggtattcctcaaaaagactaataattattgtagttggaacaagaaattgtacacataatgagaatcaaacatatattatatcgttaaatagatcatcacactcatgtcatgggaatgtaacatgacttataccattgtactcatagttgtgaaatctggttcggtcattgactcgattgagatagtggaccatgaccctggtttgacccggtatattattaaaattttaaaattatatatgtatctattatatataagtatataactaaaattatttgtgagtaagaaagatccatattcgaaaattaaaattaaaaaaatccaattttttcaaaaaaaaacgtttccatttttttttatactagctggatcggatcgattcaactgggatccggtaaccaacctgaccggatttagccaggtcaatccagatcaactatataaccagcccgaaagcgaaactgacccgattagaccaatggatcttgatctgacctatccaatcgaccactctaaaccaatttttataacactcattgcaccgaccttgttacaagtcacattagattattagattgttattaaattattagattgttagtgtatataaaaaaatcaattttatatataaaaaaatctaacttaaaatatattttaaatttcttattttttattaaaatttactttgatcgtttacttttaaaaatcttttatctctcaaatttaagtcaatattattcttccaaaataatgacaaatgagtaaaaatatattttagcagaaaacgtattatttttttctttctgaaaatcaatttttcccacctttctctttttcctattccttctgtctttcattttttttttattgtgccataatacagtgagtggatgtatgtgtatcatgtgtacttctgaatttaaatacagagtatcatctttcagttggcgctttttcattgtaaaagcaaaaaccaaaccctagacaaacgcccacgtacagtctcaaattaattgacagcaatactgatccaagtccagctctttcatccttcacttcactgatcaggcatcgaatcgaagtgaacatcactgtactcaagttgcacaataagctcagcattttgtcaaacagaaagcaggcgacgataactaatgggtgggatattgaagcaaccgggcgcgtttgcaatcacaccgcacaaagtatcactctgcatacttcttaagatctacgctccacccgctcagatatcggtccccttccctttcgcttccgttgctcagcacaatcgccttggcttgttcttattagccctcaccaaggtctccacttttttttctttcattctggacaaatgaaattgcatttcaatcaattctaccattttgaatttgaatttgaatttgaactcatcacactctggaaggagggatttttggtctagttgtatcgcaagcagcttgtgctaaatagtgctcgttttttttcttagcttctcgccttgtctgttttctcttaccgggttctcagtaaatacttgtagcagaagaaattaagaaggtagaatgaattaaacttttcccataagttaaaattattatgcattggctaagttatataagctctctcatttagcttctccaaagtccaaaagctaataattttaacttacacataagctaatcttaacttatgggagaagcttaattcatcttaccttcttactttctcttattgaagagtctattcaaataggatcttagttatctttgggcgtagtgccagtggaatgggcatgctattttaattgtttttagcattcccatattgtttgggattttttactaattcagtgttggatcacacattttcttcatactggtgtgttgaaaatgttgttaataatgcagtcctgcgattatatattggagccaaaattggatgaactcatccatcaattgagaatgatgagccagaactgggaggcttcctgggttattgatcagttgatgagcagactatcatctctgtcatcacctgatgatttgtttaatttttttagcgatatacgaggtgagttgatcagctttaatatttgctagcctttgaccctttttcttttttatatgttctgtcttgtttgattctgatagaaactggaccaggcttctatcagattccgtcttttatcctttttattttacttgcaagtagcagcgcatttggttattgcctatacgttagatcaaatttttcatatttactgatagtaagatgtggttcaggaatacttgggggtcctgattcaggtgctgtggaagatgaccaggttattttggacatgaacagtaacctggggatatttcttcggcgttgtgttcttgcttttaacttgctatcgtttgaggtatgatgttttctgcaatcttaagatggtttaaattgatcattgtttgaatatttatatgatcattatccatgtcaaaaaaaatggggggaggtgaagttgtcttctttgaagctccataatattgctaggtgcttcgaacaaagtattgttgtctcaagtaaattctaaatgatacctttgaatgagtttacattggtattactaaaattcgtggagtggggctcagcacctgttatcctttgttttcatgatgagcatgttgctattaggagtttaatgtacaattttgagtctctggttaatttttttttcttactcttttctcatatgcttagtttatatgtgtaattttcacttttcttctttagaataaaatcttatcctcctcataacctctaatttgggtgtccagggtgtatctcatctcttgacaaacctcgggatctattgtaaagaagaattctcaaattgtcctgcctatgaagaacacggtttagatgattctagtagtaatctggagacatattcagaatatgagaatatggacctggagaactttgtctatgaaaaggtttcagaagaaattgaagcaagaaaggaggctagtgaaattgttccattccatcttcatacaccgaacactcttctgagcttagttgatggtataaggatctaatttaattgggctgcccttttattgttttctgtagttttgaaagcactcgaaaaatctagaccaggatatttaaccaattttccaaatctgttttctgtttctacacttgtttatcctgcacttctcttttgggtttctctatttatgccttgctcttggaaacactgtttgacacaatgacataacttcactgataatgttggaactcacatgcacagatattgatgtgcctgctgattcagtatccaaacagagtgagaaagttagagtagctagtccttatgaggatccttcaagtaacatgctgcgagatgttgatcacagcagcgcggtatttctgcggacaaactggcaggtacaagggtacttgcaggagcaagctgataccattgaaaagtaacaacttgtaaacttagaacttcactgattttttttttttttttatttttaaaattaactgtaatagtgcatgcaattatattaaatttaaagttttattcatatattgcaggaatggtagtgctgtatctttcaatgggcttgaaatcattctacggcaactacaaaagttggcacctgaacttcatcgggtaagtttattagatttttttaatactattccttcaatatattagattttttttttttcatttttgctgggatattgactttcacttcaatccaggttcactttttgagctacttgaatggtctttctcatgatgattatatttctgctttggagaatcttcattgctattttgattacaggtaattaagcggttatttctttattcaatctctttgacggcattgccaatgtttgggttcacttgatgactaattacatataaagcaagcagaaataatgcatcattcatttgtggcagttcattgtcaattgatattcattgctacctcaataaccacaattgaccctcatccaacaaaattgttgacattgctagtctgtttgcgtgctactgaaggccattattgtcttgcctgcattctacttttttctaataaccttattctcttcatcttcaatttgacattaaagtttccctacataaattgtaaaccttttccttcatccatagattttgtcttttgctttgaattatagatctcataactatatttgtcctgtgtacatacccttaagggagtgacttaatagccaataaaaaggatagaggaacatcatattctgcaactgaacttgtctgttatttgttggacaaaagtgcagggactgaaggatttgattatattccttcagttagtggtagtggctttggaagatatgaaattggattattatgtttggggatgatgcattttcactttgggcatccaaagctggctttagaggtaaatttttttagcattttgattttgatacgtgctcagcattctaccttttctaatcctcaaggcttctacaatttgtattattttgtactccactagtcattaagctaatataatactatacatttttttggtgtcacttatattggtttgtgatgtttaggttttgtcggaggcggttcgtgtttctcagcaggtaatcatacaaaaataagttttatttattaaataaaattgtgaacatgtattcaccaattattgcaaaacctaagctgacaacaaatgttgcctgtgcatgctatgctacaaggggtacatggcaacataaatgttgttggcaaatattgccatatgttgtgctgtaaaaactgacaattttcatttgtgcagcaaagtaatgatacctgtcttgcatatactttagcagctatttcaaacttgctgtttgaaaatggcatctcaagtacagctgcgacactaggatcgtcatactcaccttttacaagtataggtatttcgctctctgttcagcaacaattgtttgttctcttgagaggttctttaaagagagcagaaagtttaaagttaaaacggttggtggcttccaatcatctggcaatggccaaatttgatctaacggtaatgaaattttctgactactttagactaaacattctctttatactgctagtactttttctttatgaatcctaagcaataatgtaaatctttgttgtggctttagcttcttaaaatattcaagcctcaaatatattgacctgttagtataagaatatagtagagacatggaattgtgcaaattccagataatcaagttcatgagttacactgtggaacgtgagaaagagttatagtgagttgattaagatgagacctgcatttgagagtgtttgggtttatgccagggaggtcaaccatgaaagctttatgtctactgcagggtgtgatgtatctatactgaaggaaacaaaaagatccttgcataatcatcattgagatagatagagtatatgccaggatggcactagaagtcttatggaaggctttagcgaaggattgactttgaatccatattaatgttaaatggattgtaatagagttttatatgtggtactggactttccttgatatccgattggttagctatttaggattgaaatttgcttaaaatttgatcatgatacatttacttcaatctatcattaagtttgaaccctaccaagcaagaaagcattttttggggtgggaaaaatgtttctctccctgaaaggatcgagagcctaaatctgtcatatgatctatatcttaggtacgaactccgtattttattctctcaagtctcagcacatgctactgctcttgtttctattgctaccatgttgaagttcagagcactgctttgagcattccgggttgcaaacaaacaatcacttttttgggatggaacattcccatatgtgggataaaacataatagggatataagcataataggtgacactttccattattccatcagtttaccttggtattggatgtagttattgggcacattgaatagctagtgccttagtgtatgctttatgctgacaatacatgacagacatggttgtagttgatgaattgagagaaagaatgaattctaaacttgagtcatggagagtagctttggaatgaaaagatttttgggtaagtaggagtgacagagtgagacacaatgtgtggaatacaagttcaatgagactcaacttgagtgaacaatttcttgaagatgaaaattagggatcagatacatcatactcgatgttgcacggtttaggtgtgtcttgaaatatgactgtaattctaataaattttaggatctcatttgttaaagttgaatccatagtccatgtaccttacatatcatcattatttttcttatataagttatttcaagctctaccaacttaaattagatcttaagtcctgttagtgagtaatgaaacttgaaatttgtcttatgccatttacatcatggtaatatcttgattgcagcatgtccagcggcccttgctatcatttggtccaaaaacttccatgaagctcagtacttgcccagttaatgtttgcaaggttgtagaaatctttgtgattattctttggtgacagtttcagaacacaagaattaaattctttgcttaatctattttcttcttatatggctggcaggaaattcggttgagttctcatcttattagtgattttagctatgagagttctgcaatgacaattgatggtgcctttagtacagcttggcttaggaatttacaaaagccgacgggttctcttgttttgtgtcaagagaatggatctggcaatagttctaatgcttcccaattcattgcacaaccaacctcaattcctggatctgtgttgcaagtattgggttcgtcttatatacttcgtgcaactgcatgggagttatatggcaggtaaagttgctatttgtgttgagatatgtttatatgaaattctgaattaaggttacactaattattgttctatctttttttttggaaattgtcaactaacatggtataattgattaaaatttcattgctttaaggctaacctattaataaaagaaaaataaaacttgctgtaacaagctggcattgcttttcttgtattttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttgctgtttttaaaatgagagtctaacttttactgaattttaatccatatatcaatgttctattatgttaaaaccttgaatgtgactgttatttatttggcaacaacaactactccttccctttgctatataattataggttgagacttattggctgtgttagccatatcaattgttgggaaaggtgggaaagattattcatgggtcacaatgcttgaatataaaaaatggaagtggggatgtaaaaatagggccaaaacttggaataaatatataataaaggaactaataaattggaaagatgttacacacaagcacaccctctgctaagagatgacatagctggttttattggagcatttatgtatgggtgagtacaagtgtggtaatgaatgcaaaagatgaacaacaatcatggcctgaatgaatttttggaaagacattatccttgcagtctctcttctattgtaactattttcttaatcttggattgattttctgtcaaatgattttctttctcagtacccatcaaaaacattttaatggtattgtgccattctgtgtagttcttcatgtcaagcttctgggaagtgactatttttcccttttatggaaccaaagtttaaaagaggaaaattatccactttaattgaagacaaaatactcgagagagagagagaaagagagagattcagacacatacacacacatatctctgtaatattatattcttaaaataaattagcagtcatttctatttataattcatcagtgaaagtaaaacattttagttgctattaaggtcttgcttaccaaacattcagaagcaaagttcacccaattttttctattttagggtttaatcaggtgaactatggttttcaaacacagctggatacatcataagggtatactaggttccatcttgaccaaaattccttaagccctggttgtattttaccaaagttatgtttataaataaaaagggattgcatgctttatctttgcagttttttaatatcttgaaagtttgctgtatgtatttcacaatctgattttttttttctttttcaattgtcattagctcaccgctgtctcgcataaatgcgctggtgcatgcaactcgctttgctgatgcatcaaggtagtttctgagctgaatatattacagagatcacattctaagttgttattatcacctttgtttattatgaaaaataactgtatcaccaccattttgttaaaattttctgttgaattatcttttggtttccccagctcatcagatgcagcattagcatatgtaaagctcattcaacatttagcagtatttaaaggatacaaaggtcagattcgttgcataaaattgaatagaattccaccattttttttaaatattgtatgtgattgttttcaaatttgcatttgttttatcttgtttttgtacttttgctaatagtttgtaagttgccagagtaactttttataaaaaataatatgataaattcagcttaatggcaattatttgctgtgcaaattgcattttgttaatacagagttgtcatttttcttcatcgagattgttgatagtggatagaaatgtccactatcacccattcgagttccttacctttgatccctcttattgttctgacttcttcctttttctttgtttctagaggcctttttcgcccttaaaatagcagaagagaagtttctatctgtctcaaaatcgcaaatcttactgctaaagttgcagctgcttcatgagcatgctttacatcggtaagttacctagttcatttgttgtattaagaatcttgagttgtgttagcatctgcaatttcagctcacttaattgagcatcatgtagtggacaattaaagctagcccagaaactgtgtgatgaacttggtgttttggcatcacgagtaactggtgtagatatggaactaaagacagaagcaagccttcgccatgctcgtacattgcttgcagcaaatcaattccgagaggttttttttagtcttcttctatgtactaaatattaaactatatacagaaaatcaatcacacactattcacagtttgattcttgaatttatagtgcatacattactattgttcttttgttggaaacatgggatcacactcttcaaatatattctgttttacaagtgtccttgtactatatcatttaaaaaaaagccttaggttgaacaagggatcataccctttgagtatattctgttttaaaagtgtccttgtattgtatcatttgacaacagcataggatttgtagatttcaagcatgctgtatgcaatgctgttattgttatgtattaaagtacagtatgtggggatcttagcttccttgccccataaggagacaaaagggtgaaatcaatcactgttacctaacagttgaacatttaaaaaatttactgtttaaaatctgtatagattgcttttaattttcatataatgattcttttaggcagctgctgtggcacactccctcttctgtatgtgctacaaatacaatcttcaagttgagaatgcttcagttcttcttttacttgctgagattcacaaggtaaattatcatattgtctaacacacttgttagtttcatgtggtgtggatcaactatcaaacacttttttatttcattttgctttatctgtatgatcatttttttttcttttctttttatgcttgatctatgtctcatcctaaattaccggcaatctgctacattgtcccaaccctagctttcacattgttgtgttctctactgttttttattttttttattttttacttaaagctttcattcatttgtttttatcagaaatcaggcaatgcagttcttggtcttccatatgctttagcaagcctctcattttgcctctcatttaacttggaccttctaaaagcttcagccacacttactctagctgagttgtggctctctcttggatcaagccatgcaacaagggctctaaaccttatccatggagctttcccaatgattcttggtcatggtggtttggaactccgctcacgtgcctatattgttgaagcaaaatgctatctgtgtgattcaaacttcaatggtatgtcgctgtaaatagttgatgttagactatgctcttcaaatttgttgtctatccatgtatatttaaacatatgctgtttttgcaagtatttcaatacaatagccgaatttctgattctttaaaaagataataatcgaatgggggaaactagtttccccacattttcgtcatagttttctgagggtgttggtcctttttctccccccttgttggggctttaactgaatcttacttgactgatttgaatttctttttcagtctttgaaaattatgagattgtgttagattcattgagacaagcatctgaagaactccaacttttggaggtaagcaaactttctgccttttaatcttttttgtgtaatcccttgtgagaggaagaaaaatgagaggtcatgtgaatgaatctgtgtgtcttgactacacagtggaggctcatatttgtaattagaactacaaatacagtagagaattgtcatataattatactactcataatatccctaatttacaatacttctttaacactatattacataattacaagcttccgaacagtttttattggtcccttttcatttgtaagcctttttgctgcatctctgcctcccgtcaaagttcacttggatacatgattgcatgcatgtgatagatactagagtattgtgtgtgtgtaaagcgtaaaatgaagtagggttgactgttacaatgaaaatccagtgcaaaccaaaagcagaggcatacattatattcgggcatatagatactagataagtgtttatcaaattggatttatggggtcttaatacattcaagatttatgttgtgatggtgaaagctcactagtcaactagtaaaaaaatttcatagtaaaattgactcatttaacccattattttaaacaactcttcaacacccaaatccctttctattgctttttatttaagatttgattttcttgcagtttcatgaactggcagctgaagctttctatctgatggccatggtatatgacaaagtggggcaattagaagaaagggaagaagctgcagcttcatttcagaaacatattttggctctccaatcctcaagatgaggatgatcctcttgttagtgtgttttgattgttctttatagtttatacctaattttatctatataagcttatttaattaaatttatgtacaatagtgacccctgatcttctgtaattatcattcaatagctgtagtcattttgtttccaattgtaaccatagccaagatgtacggtggcataaaccttggagatattttgttctctcttccctttatagaggacaaccgttcactaatggacatacaaacgacaattagattatttatcattttaaaagattagatattttttcttaaattattcttgtgtattgaaatctccgccacatggaatgagataatattaattatgaaagtataatatagttaataaaatttatatttctttcaaattaagagtatctaatgatttattttaaaattcttacagaaaattttcaattagacatttgtaccattagagaaaaactgtaggactcatttgtttattagattatttctgctagcaactgactcttttatacatttcatttttacattcctttcattatgcattattaacagtagattgcatctcttaaaaaaaaaacattagattgcagtattgctttggaaatatggaattataatgttaaaatattttaacgaataacgatgtgtagcttcaagttcaagaaacgttatacagtgcattaatgtttgaaattttagtgtataaataacgtattttttataatactttttacacaacaattcttttaatttttcttatcttatttcatttaactgttctcttaaattttcttatctttatttcctttctttttacacacaaatgaatcccaaaaacacattgttgggatttatttgagttcttaactttaggaactaaagtgacatgaatatgtaaatttaaagactaaattgactacttacaactaataaaaatagtacatcggacccaccctacttcaactcgtccataatattttagttagtacgcgcaaatctttatttgctgaaaagaatagcaacacattaattttttaaaactgcaatctttctataaagagaatatatactaatttactagatgagtatattttaatatattaatatacttcaaaaatataaatataattcatatttctcaattaattataaaagtactgtattattacttgtatgcaaaatattttttattaattagcaaaagaaagacacaaatgggtacccaaaatcacatacagtgccatgtatatagtgtcatatatataccaaatatataataatttttttaaaataataaaaaaaaaaaaacaattctagaagaaaagggtgtgataaagccaagagaagcgtgtgaagaagagagagtggaatgtaaggtgtaggtgataggcatgtaataataagcaaaaaaagagtccgaaaggagtacatgaacatcatccaatccatccacgtcgaaacagtgtcgtaatctatttccatttcttctctatcttcacttcctcgtcctcatcctcatccacacctattctcaacccaaacgcaatgcaaccttatgcgcccactccccgcaactcccattccccttatatatcacaaccaccaacctcagaaccagcaccgcaccaatgccattacccaattccaataccatgtgcaatcaaactgcctttcagctccttggtttcaataacttcgtccgaaccaatcctaaatcggaccgctttcaagtcaaccgcttccaccacatcgagttctggtgcaccgatgctaccaacgccgcttgccgattctcttggggacttggaatgcctattgtcgcaaaatccgatctctccaccggaaaccaaatccatgcctcctacctcctccgctccggcgacctctccttcctcttctccgctccttactctccctctctctccgccgcctccgctggtgcctccaccgccgccattcccactttcgacgccgccacctgccttgccttcgctgccaaacacggcttcggcgtccgcgccatcgccttggaagtcgccgacgccgaagccgccttcagcgccagcgtcgcgaacggcgccgagccggcgtcgccgccagtgctcctcgacggccgcaccggcttcgcggaggtgcgcctctacggcgacgtggtgctccgctacgtcagctacaaggacgccgcgccgcaggcgccacacgcagatccgtcgcggtggttcctgccgggattcgaggccgcggcgtcgtcgtcgtcgtttccggagctggactacgggatccggcggctggaccacgccgtcgggaacgttccggagctcgcgccggctgtgaggtacctgaaaggcttcaccggattccacgagttcgcggagttcaccgcggaggacgtgggaacgagcgagagcgggttgaactcggtggttctggcgaacaactcggagacggtgttgctgccgctgaacgagccggtttacggaacgaagcggaagagccagattgagacgtatttggaacacaacgaaggtgctggtgtgcagcaccttgcgcttgttactcacgacatcttcaccacactgagagagatgagaaagcgaagtttccttggtggatttgagttcatgccttctcctcctcccacctattacgccaacctccacaagcgcgccgctgatgtgttgaccgttgaccagattaaacactgtgaggagcttgggattcttgttgacagagatgatcagggcactcttcttcagattttcactaagcctattggggacaggttcctcattttctgcttctttttatttacatttctcttttttatccctgctaaacaactttattataactcaaatcttcaactatcactgaactaatcactcttaaatttacattaaactgttccttttattctcctactttgttagcttctttttttttaatttgattttcattttttaaaaattttaattgtacaattatattctattaattaactttcaataattaacaaatgatggtacagtggagtgttatgtcagaatggatgtacttgatgtagcagttcatcagagtgtttcccctctccaaattgtacttatgtccctttcatgagataaaaagtttacgacattgaaaaaattgatagataaaattgcaattatatcttgaatttatttatcttccgctttgaactgattgaaagtggtaaaagttagattaacaattttacagtttgtgtgttggaggatggtgattagttaaatgtgttttgtgttgaattgacaggccaacgatattcatagagataattcagaggattgggtgcatggtggaggatgaggaagggaaggtgtaccagaagggcgcatgtgggggttttgggaaaggtaatttttccgagcttttcaaatccattgaagaatatgagaagactttggaagctaaaagaactgcgtaagcacattggaagaacacaaatactcctttgttgaaatgattaatgaggaatcgatgtggcatagggtgtttatactctaatacataatagaattacaaggatagtgtcttcccttgtatgaaaatcacagaaactttgatggatagtatttttctattaaatactttgagagattacttgatttgtttcctctgacggatacgaggcgtccccaaccacaactttatctgccctgcttgtgaagtgcactttgggggattccatgagtaactcatcttgattctccctgttccacagcatcctactttttgcaacatcatatcatataactgattatggacctgttttgttgaacttctctataaatatttctagaagaagaatttctagaagaagaaaacaagaagaaaaaaataaaatgagtttctctataaattaaaataagttttttattaactaatttgtaaaggttatctcatcttttaaagaagatatattattgagcttttaaaaattagttaatgaaaagtttatttttatttatgaaaaaatttatctcattttttcttcttattttcttctcttaaaagtgtttctagataaagttatccaaatatattctatgtataatagcataataatatgaaaaggatgaacttttttgagtgtatgagttaaaggaaaagatacaaagaaagaaaatgacagatgtaataaataatataatggaaataaaaaaaatgaaaaagataatgagtatatgatgattataactcataataatgtcggtttcatgctatttaacataattttttagaaagaaaaaaaaaagtaagttctattcattaatcgctatccacatgatgttgcgtaagatacgcaccaaactgaagtttaatgcatttaattgcatcaagcaacaatcctaactaaactttccagatgtggtgatttttatgatatcacaagttttcctgacagagaaatgataaggaatatggttttgaaccttgcatagttcaaatgtgtttttgtagtgaatccaagttctcatccaaaggaagagaagctaaatatataacaatgatccaatgaaactcaattttcaactgaattacaatgccacaatatttgttccttcacacaaccatggaggtgtacaataatatggtgctctccaacagcaagacaccctaagatcacaaaattcctgaaggaaaaatttcagcaagtaaaatgagaaaatcctcatttgaagtggcattgtcaaactcagttcctgcagagacaaatcaaacaccattacaccagtagaaaaatctgatacaatatataaacctggatccaagtgagtaggaactgcagtgtttagaccaaaagtcttagatatgtaatcattgtaatgagaagcaatacaatacaaccgtcagaagtttcgattgttaatggttggaatgttgtttacctgaatccactgagaagtagtagtcttcaaaatactgcgggaacttgggttcctggtgattatttcaactaagaagagccacacatgacacaaagtatataattttcacattagttttaactagttatgatgctaccaataagagtgcagagagcttctggtaaatatgctatgaatgggataagtagtcatgactatgactcatgatatatatcacagaataagttacaagacttttacaaaacaaaaaaaataaataatttaaaatgatttttccgttgccgggaatcgaacccgggtctcctgggtgaaagccagatatcctaaccgctggacgacaacggattttctgtacgagtgggtgaacaaaatagtaaataatttttatgcatcacaagcttgtaatcttgagtaatgagactatgatagtgcagcagcatttgcatatatttaaggtttttaactcacccttagaatactggaatcgattatgccagtaacatataaaaagtatttggcacaattcatcatgtctatttatttttcttttccatcttttccttttattcttttttttttcttttatgaattgaattattgaaattctctcataaatataaaattttaatcagacatgtttttgtaatttacccaaaaataatatttttacttatagtactgatatgtcaatttattgttgatattgaatttaattaattaatgaaacagttaaacatttttgtagactaatataagtgtatatttaaattaagaaaaaatgttatcaaaagtaaatcaccttaataataaattgttaatgttatctatccaaaaatgttttaattgatcgatgataatatataataacagattgttgtttactagatactaggcttgttgtccataaggatatcctttaaataggatgtggattggcatagactgtcataagaaactaggtactagacttgttgtttactctcatatgcagatattaattaattacaagaatatccatgttcccctatgaggaatcctagaggcaccaaattccttctacttagccctaggagtgagtgaacaacgaaagacttatcaaggttgatccctcgaatagttttcttagccttctcaccacttgcatatgtcttaagaagacaccaaataccaacattatattcctccagcacaactttcattagaatgaaaagctttatacctcttgtacccttacaattccaacgaaggacattcattaagaaaaatggttattagagggttttaagcaataaaggaggacaaaataactgtattgaggccatgtgtgcctacccttgtgtctctagaataggaggtttccttacgccaaatgagttctcttgggatgatgaggtcgaagtaccctaatgaccctagttgcattgctttaatgaaagcccttgtctccgcattgggaaacaccacgtgagtgataagatttttatccaatttcatggtccccttttggctttcgcggagccattttgttgcatgcaagatgcctataccttgctcgtttttctttctcgtatacatggaagtctaggacacatatcaaaccaaagagtaaaacactaactaacaaaaataaaattattattaatttttataaaacaaaaaatatcacatattttaacaaaaaagtcgcatacattgataaaaagacttaacatataattttctcatttaaagaattttttttcttaatatttatcttaggtctcactccattatcctggttgtccattgaattggaatccacccatagaatacttgcttttgttttgatttcaatgcgcctccattttggtcgttacctttggaatcataaataaattttttaacacccaatttgttacctaggtaatccttttccacgagacatttggggatgttctcccctatgattgtttcaaactttaaccaccatatgtctattaattgtagaattattctggctatcacatttgcaatgaatacaaaattattatagctatcatttgcaattaacgtgacatcttggtactgattcaattttgaatcttgatctggtttccccttttcgatctgttttttttcaggagcttcacattaatgcctttcaaaactttaacattgatttttgtgccccttggcgtcttacacacatttttaccctttttaactaccatccatggaccgtataatcccgccttatcttgaacaaattgattagccacaatttgcgactcattaatttgtttagggcttacatgagcatgattttccttttctccaccttcatagctttcatggtagcttcctgctggtgattgtgttgggacatttaattgttgtttgttcaatccctaatgttgcttcactacattgtgagtccactttcatccctcaaactgttagaaaacaaaagttttttttttttattatatcttttttcttttcattggatcctagcttagatttgtgccaaggtttagacaaaaagaaaataatatatttatctgaatatcatttattagttatttgttgaaaaagtgtcttttgaataattgaacgccatattcatgtatttaatatatatttctctcttccaattcctataatcttctgatcatttggaaaattgaaagaaaaatagtatttaagtaatatttttaattactttcaatgaaggtagtataatatattttctaagaatggattggccgggttctttatgatcgtacttgccataattaaaatatattgagtgaagcccttcgtatttcaattttagaatctaacccaagacattgattcacgatatattctagctttcttcctaggtcaatttcaacatagattctgcaaaatctccctctggagtgtataaagttagcatatcgatttttaaaatggttcccagcttttggacctgcttaccataagaacttatcctcatataattcaatggaaagacctagaatgtagatataaacatcaatcttgtggtctgctaaatatgatataaccattagaggggtcacttgttttaaggaaacatatgtcatgtaatatataaatgggcatctcttataccctttttggttagtaattttgctgaccaaaaaaaaaatccatggtccttcaaatagggcatgccattaatcttctttaccgagaactaattaaactagttagtagtaagtcttgcgacatattgataatgcgtatagttcccattttagcccattccttgggtagcttgtgttcaatcataattaaaactatctttcttcccaagacatcaacaatatgagagttcttccgggggtcacaccattattcaaattcttcattcgagataggaattattattggacatagttatagctttgtagcatcattattattggcatactcctaattaccttgtaacatctaccctatgaatgttacgttccatatcatctacaaagctctggaagtttgccacaatctctttttcagcctctaacaaggtatccaaataggactttggaaccttatctttctacatattgtctttgtctctgccctcagtaataacctcatctatcgtaatcgaaccttccttagtcttaacctttttggtactacagttaaaagagtcttcctcttcttccttagaagtcttagcaggaaccctaacatagctcttcacctccctcagtcttatgccttatactttatagttgtatagatgttttcttggctttcttcttatttttaaatgttttatatagccacattcatggcctaattaagaaaaaaatcattctaaccattattagatcataaccgtaccactttgcagttgcttttcaactatataggtaaattttatttagtttcagaatatatagttttgtaatttattaatataaaagtatatgtgtaaaaatttgctggcatttgatccttcccttagatgttattgaatttgcccatgaccgatcttggtttactcgttttatctagggagaaattttcctaatatagtattaaaagactacgtagaactcagttttttatttatttatctggattgtttacaaagcactattgaattcgggcatgacaatggatgagaatcgagtttttgctatatagaatttatggactcctcaagagaatcaggtcacccgattttccgtcttttgttattattattattattattattattattattattattattattattattattattattttcatagtttgagcgtagacttactcctgcaactgcaagacgtggtcacttcctttttgaaagctttgttagtatataccttaactcttgtacaccttcagcttagttggagaataactctttcatgtgtaaaagcaattacttaagcataaatgctaaaattcaagggttgctttgaattaattcaataatattagtaataataagaatacacaattttttccattttacagtagaagtaatttctttcttgatttaaaaaaaaaaaaacttaaataattaagaattaattagccccggccaaatcaaataaaagaccgaaaaggaagcataaggaggttacttttctgcgcgtaggcatgcttgctacggtgctaccccatatgtggttcggaagttgatatataaattagtttattggcatggcaaatcaatttgagagatcgagtatatatctgtcaatatcttagtgattgtgacaaggaccatgaaatacctttatgtgttgatcatagaagtatatatgacttcattattaaaataattgatagattacaaaacaaacctaaccttgtttgatttaaagtccaagctggtgtatgcatgtttcaagctatattaatattgtattataagggatgatgttttcagaaatactataacaattttttttgactaaattcaaaagtatgtttgattaaattttaatattttttaaaatgtttaaattcaaaataatgaaaataaaatataataatagaaatataaagtataattagattcgaaaataaaaataaaaattttctgtacatatactcttatgatataaattttccatatcgtattataggaatataataaaaagattttattacttatctgaacataaataatatttaagaatacttaaaaaaaatataattaacatgtaaaatattacacaccaaaattcatatgcataagaataaatttttaaaccttaataaattcattccttgcagtaacaaactcaatacattatcaacatgattaaaataaaattacactctaattctttaagcaaatattttatattaaagtactgtggactaaaaaacaaaaacaaaattcactaaaaatatttagttagatttcatgataaaaaatgattattaacaaagtcagtaatacttcatagttatgatatgataaataaaaattcaaccgtcaacaacatcaataataataataataataataatctttcgtcgtactttctgcacatgtacttgatgaaaattaaatagcgtcactgaagcatgccacttggcagatatattaaatggtaaggaattaaatgccaattgcatgccgcaaggacttatttaggttaattaatctcatccaaccggtgaagagccttagagccctatatatattaatacatagtcttctgtaagagaaagcaatagcagggaagatcgatcgaaatggaagaaggtcgcaaagggtatgttccagtgctagtgggcaaagggggacacaacgtggagaagatttgggtatccatcaaagcgattcagcatccaaccattgttgagttgctggatcagtctgcagatgagttgggataccagcaaggactcctcagaatcatatatgatcttcacaacttcaaagccattcttcacaaggcttccaagaattgtatctagcaaattacatccatgatgtcttgtttttcattttctgttaattacgacccattctcaaacatgttaatagaaaataaataatcaattcttacttgctcgctgtgcattcaactttttcttctttttctttctttctttatagtggaaaactaaacacaacttttccccccctcattttctccgaattattttttcttgctaataacatctacttagaaatctgactatttttaatgaatttttttctcctaattatattttttttccactcaaagacttaaacataaaattttactcaaaagatccaaatctaattctactcgaatcataataatgttagaaatattatgtttatttgaaggtatacaatatattttttaattaattgataatgtaaaaacttatctaccaatttttctagatatatttatatataggtaaactatatttgagaactagtaataaagtatttaatgttataatatgaagagggattaagttaatgtaggtaattttaaaagagatattcttcatttgtgtcttttcttttcttttaatgaaagggttctaacaagtaatnnnnnnnnnntatatatattaaatatgatagataattaattaaatttaactttattcaatacaaaatatttattagatttaaaaaatacaatatatatttattaaatgtatgacttttcttataatttatataagtcttgttaactattgtcgttggagtattggttaagaaaataaaataaaagagagcaaaaatgatcatggacaacacaatttttcatctctcaataaaaatattttcactttaaattttttaactgatatactaagataattggttaacatcagtatttgtcaatctatacatattaaaaagtattgttaaataaaaagtgaacggttttttatacatttattgttgcatttaataaatacaatgaatctacatattattttattacagtaattaatatatgttaataaatataagacatttaatgagattcaaacgtacatccaattgcatatgttttagaaacagtacattaacaacttatatcctaggtgtatttaagttgtaatttgctaaagtgttccttctcacatgaaataggtgcatttcaaggatttgttgacataaacccatttgttttgttggagtactctagcaaagttcatattgggtgtattttaaggtgatcataattataacttgttaatgttttcatttaaaattaaaaaaaaaatagtaagggtatggttggtacgtaaatttctatgcataaatttatttgatttattaaaacgtatggtttggataatataaatataaaagtttcttgtttcattttaaaaatagataatgagatatataatacaatcaagtaaaaatgaataggaaaaaactatcattttttgttgataaaccatgagacaatgttttgtttcaagtataaatacttaaaagataaaaaaaatactcatttgacttctcatttaataattatattttttatttcttatccctcaggattatcaatgtcgtcagcatggtcgttactattatcacatttttttattattgccaccaaatcatcacactcattggcaccaatattattattattgtcttcctttttattatcattatcatctctattgtttacaccacctccatggttgtgcacttgttttgattattctcattgtgattgtttttattaccatcattattattattattattactttcattatcacctttttgttgctaccaccctcaccataactgtgtcatattaatataattaatatgaaatatattgaaacaattaatattagtaaaggaattatgataatatgcttgttaaaataaaaaaaatgtattaatacctacatagtacagatattaacagagtacttaatattgttagtatagtatttttataaatatataaataatattattttcatgtataatactaaatatttatttaattataatacttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatacttatatatcagaattttgtagcttataattatttctcaacagatttttttcccttagctattttcatacttttttactgtgtaaaatttgatttgttgttgacttctaacaaaattaattatcttaaaatcaattttatgattatgattataatctattatatatataattgattattaaaataatttaattttttagctatcccaaacacaccctagctattctatttaattaaattaattatataattaattttaataataataatattattattattattattattattattattattattatgaatatagtatattaattgcattaaatttttataatatatgtttattaaacatatggattttcatattagtcaatgtattattaaatacaaattaattattatagaatttaatacttatatataatgaaatatactttaaaaaattattgttgttatataatttttaaaaaatatactttataaaacatattttgaaataaatataatttaatgaaattataatttattattgttgttagaggtgttgttcccaactaattgggcaagttaatgtgggtggacaacgggtgaagctgctgtatttagcttgcaatggcttgagagaagaatatcatttgttgagaaacattattaattactacgaaaacaacattcttaattaatacagtctgttaacatctagtttttcaatatcaaaacatcgccattttttatttcttgccttcaggaatgttctgatagccgggaagcgttttgagcaaagaatatcataagattttagttgtgcacgttccatatgatattgttcatttaggtaaaatgtttattatattttcaattcccgttatttttaaatttcagttttattatttttttcttaatgaaatgcattactaaaacgggaaccaaaagctaatatatattattgttagatgtggattgtattagttttccttagccatatctaccagtaatgtattgctaacaataaaagtaggagctacaaaaaataaatacaaaacagacaattactgtttagtccagccttagctaccatttgtaactttttaaaaaaaaaatcatttgtaacttgattagcctcttgtaacacatgtagccaaataatccgaccaatatgatgatacattatgaatggcttgcaccaaattaacccgtcatatatatatatatatatatatatatatcatttttgtttcaaagtttcaattaattaaaattaggattctcattagttatttctagacatcgcgtgtattcatttgtcttcaaaaagtcaatatcaaaactcacttgtagaatccaaaatagaggatttggttctaaatcttaattagatattcatttagaataaaaaaaggaaacatctgatcagttaacatatcccaaataaaattcatcactgaccaatatttgattcaaattcgttatctataacttagggcattttaattatttaatatagatatgtcatagatattcctttttaatgtggcatggctattaaaaattttgagcagcacattaatcaccgagagaaggtgacacagaagggagaaaagtccattggttaagttagggaggaaaactgaccaaacagaagaagattgagggccttggtttttgatatgttagagcctagaatcactaggtcgtcggcttagtggtggagggcttggacctttgaaataatatgtctgagttcatagatttaaacatcagtacgatcattgtaaaaaaaagaagatatgttagaactttcaacatgctcatcaatatcataatggagcagggagttgccacgaggaaacttgacatggtttttgaaccgaagcttgctgcagaattttgtttgatcaccaatgtgatttttgaatctgattgctttcagcttgtgaatagcaggaatggtccaaatacaaattaaataacaaaagttattttgcaggaattgttgcagattgcaagtatcttagtaatagtgccttgatatataaataaaaaataaaaaataatagtgccttagtttttacaaaaagaaggggaataaagtggcacatgaattagccaaattggctttcaattgggagatataaatattcccaatatcactgttgtttctgctccagaaagaaggccatactgatcagtttatcaatttgatgctcaaccgtaccggtagtcctatccatatgggatcttttatatatatcaattgatttaataaaggaaaaaaaaaaaagcacaatgatcatacactcatatttgttaaaacaaaactacgccttctgtgtggactctgtcaacatttctatcaagtttatactcttgcaagaaagagagaaaaaactaagagaaatgagtataaaatattacgcaaccgtacgtgcatattgatatagctacatgtgtttgtgaccggatccctccagacacacacatctatatatactcttatatatatgtaatatgcttctgaaaccctagatttggaagtaatttgtggctagaaaaatgttattaattaaaaatcagtaaataaaaatctttatatttaactgaaatttttagtgtataatttttaacaaatcagtaaataaaaatattttttaatattaaaattaactaataaaatattaattaaaagtataatatttaactgaatttaaaagtatattatttaaatattaatataaaatataagaaatacgcaattttatatttacattttattataggtgttaatttgtttagagatgggataagttgggtatgataccatttttttgcgaataattatccaaaccaaaacccggcccttattaattacataaataaaaatcctattattattattattgaacataatgaaaataatatctttttttacagaattaaaataatatcttattatttaataaaattgatttccatcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattatcctcacatatgaaaaactttgttggtttggaaaagttttttacaattacgctaaatcacaactcaacctctccccttcgtgtgatatttgtctttataattataattagtttacaattgttctgttctattttattatttaagaaaatttgtttccattacaagaaaaatatgtattaacaagttaaataataacaattcatatataaatattacatatgagtattaatatgttaatttaaaaaatattttaagataaaaaataatcaaaaaggcatttgaaaaagggttcaaactgattttctttattttttataatagataatgtgaccatttaattttaaaatgtacttcaaactgttagtataattttttttaagagtttgtctatcattagtgttatgactatcagatttaatgcattatctttaattctctttcatatcatgtattttcttcatatgcataaaattaaaactttataattattaattaaaataaataattaaaattataataaagtacatgaatatatgtaataaaattataaaatcttaataattagtattttaattatttataaagaaaactatattctttattcactctaggtaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttatatatataaaaaaagcataactttttatattagaataggcgaaaatgcaatacaactttacacatcatgtaaatgttctttactatatatgtgtctggttttgatttatggaagcatttctcctaaaccgaataccggtagaagagcagaaaggagataaaggaaaccacacaagtcacgaggtgggatatattactggaaaatgacaatcatatctaatagcatacgttgcaccaaactaagatgcccaaagaaatacacgtaacatcatattctagtaaatggggcaatcaaactcccaccatggcatagcaattagctagacgacaaccacacactctctaaatatgtacctacatttagatattgttggccaaatattattatcataggcatatcctttgctttggttttgccttctccatccatggcaatgaaaatcgtgaaccacgaaacctttcatacctgcctcttgtcacttcctgtgactgattaatgccgtattctagtagataagtacatttacacatttagaaccttctcatcttatttggtatgttcagtccccttttcaatttgcatcagcatttgattccgcaatattaggtaaatgtaattttcatgtcatggccacttttaccgcctgcttatcattgttgggtgtatatatatgtgtaacatatatacatcctttcaaaatatgtaagataataaccttctcactttgtaaaccagttaattgcctcattttcctctgcttcattccccactcttccatatatatattatggccttatatgacaacaatgatatgaacttagaagagatagatttggaggcctttgaaattgatgcggccatcctaagagaattgctagaagaagatcaagagggcaaggatgataataaggatcatggtaaagtagaatgcatagtagaatccgtagaagaaaacaatgctcatcctgacatgatggttagggagcaagaacagcagcagcagcagaactgtttggagaagtatgggtgccatgactttgagtggctcaatatgatggagccaactaatccactgaatgatgtaagaatgaattggttttcagatgacattgttgagatggtggattttggttatgctaatgaagaatgttactctcaaatttgtgatgggctagtctctaatgaggcaagttatggtttcctgtgggaagattatgatatttaggtgcatattaaagtttacctttagctagctctagaagagaagaggggaaaaggggctaaaatagctcatgtgtgaaagaatctggttagtaattcgtaaattgaagaccaagttagcagaactacatgtgtaaatgctgtttgggtcaaattctattaagacataagtgaaagaaaaagacttataataattagtttaaagagtcgatttccaaattacttgatgcatgtctacgttaattaattatccatttatctttccttattttttccatctctttcattctatattctgcatgatagctgagaattaagatgaatgcttactaagtaatagtaaaatagagggaccttgctttgatgcctcattcaggacaatatctacatattaggacctatttggctatgtagaattgataatgtgataactatatgaatcaggattattcagtggttcaaagggatgagtcaacctctagtatcaggaagtttagaacaaactcatgcatagtcaatcaattggattaaatctctgagtggattaaacctctgaattgattactcaattacatcattgtaaggtcataaatgccttgtgattttttttaatggttttgaatttttaaatcttattatccttaccctttaaatttttgtagtaacgtttggttgacattatttgagaaggattgaggtgagttatcagagaagttattagactcacgataaatgtgaagaagttattaacaaagtatttgatgaacataaaaaatattgacaagttgataattactaaggcacttttcccatatttaaaaagtttgaagcacaaagaaagattatatctaacattgaaaaacagtaataaggcttgggaattgccgaaatatatatgtacgctctgtatcttaattatgtatgactcgagtgttccatctaatcacattagttatctattacacacgtaaagttacgctcaatgagtttcaaatatgagttacaatagtttaaacttaaaataaataattttaaaataattactttaaaaaaaagttattcaataagcacataagattttcttttcaaaaaataaacaaaaaaactatttttttaaacagaaaagatttaaataaacatacgaaaaaaaaaactacttatttgattaaaaataagtatttttaacaaataaatttaaacaaattaactcaataagtttacaatacatgggtacatgcacagatgcaaaatgggagctacagtacataacatcatgaatagttgtcaacttattcgccgtccatcttgattgttgaaattttcttaattcattttccaaatggacatatgtgaagctctcagactgtttccagaggccaatcataaaaaaaaattgatggcttccttcagtggcaattatgaagtaaacatatatccacgccaacacctcatgaacagttgtcaggtatctttagaccccgcgagaaatttggcaataaaaaatccaattgtatcaagcggagatgatggatcaaacctctgaacaaggtcttcctcccctggtcgtaaccactccctgcatagacatcatggtgtgaaaccaaaaattggcactgaatttttttatttattattttggataaaaagaaataaaaggtatatccacaaacaatactaaacagcatcacagatgagtgtgtatacaagatcgtctatgtaagggagagataaaaatgcacaatcatggacaaatggatgaagggcttactctatatatccatcaggaaattcacagctaccaactatacccggtcctccaattcttgggtgctggaataaatcaaatagcaaatccgaataactcaaccaagtgaactaataattcattacagacaaactaaacatcaaaatttgtttgtagtcaccacttacgcatcttatttataaattgtaagagggatcatccgtcaattaattacatatataatcaagatagtaattcagcccgagaattatagaagcctaatcaattcaaaagaataaaaataggaaattcggactgcaaagaattagcatcaaacgtgtggtgccaacgacagatatttgtatttatccgaagcatatcgaactaatgcttcattctcaccaggattaatcgtacaactgttataatacaatagccatcaacaaatcagtttaaaagaaacgtctcaaataaaaaggggtaaaaataaaacttcagaagtgcccatccaaagataacataatggtttgaggcagcatagctacaaaacaaacttattgataattgaaaacaaaaaatctcttaaatctttcttgtattaagctgtttggctggaagcaaattccaaagaagcaacttagacactaaataaaatatatttcagaccattacaaatacatttcaaaattactaatgtcatgtttagtttaggtaagaaagtgaaaggaaagaaaggggaagggaagaaaaagaatggaaagtgagatgatttttaaggttgttaggtttgagagaaagtgaaagaaaagaaacatgattgtaatagaaaacttgtgagcatgcacagaacgatgtgatcaacaaaaatgcatacttacgtggaatagacaattactcctccaggtcgaactaattgaacagcctggtcaaacatccttctctgatattttgcatggtttcttaaagattgagttgtttcctgccaaaaacaaatggcattgcatggttattcctctttttttttaaaacaacttttttgtgggttaaatttttttttatataaaaatgaacaataaaaactaacttaaccacccagacagggatgatgactatgcatcacattgaccgatatataattcatgctgacaatttcacaaattacactttctgggcaaaaaaaggtgaatttaccatagaataaatttttttccccaatcacattgaaataaccatcacttctacacattcctgtatttcaggcaaaggttaagatgtacacttatctgtgcaggatttagtagaaaaaactaatggtggtataaatcaagaaaagaaaaatgagaacacaattccactttaagataagccagtagtccccgtatcctctctatatttgcaccaataaatctagattggtctaagcatgtgtgtgtaaattcaagtaaatgcaggataaatttcaatacgcagatccacttctacctctccagcaaacaatcgaggccttaaaccaagggcagaacagggagcatcaagaagaactctgtcaaaactgtcaggagaaaaaccttttgaacgatcaaccctaccacccacacactgatttcttccaggtccatttcgtgctcttcgcatgttcttccggatgtcagctttgctaacataagctcctccatttgtttttttgcctttacctttaaaaattatttaaaaatgcatttgtaaattgttgatacagaaatgcttattgtgtatataacaaaatataaaacaggaaagtgacaaaccatagcacagaagaaatgagccaacagaaatccaataaatctaatcaagcataatatttgaaatcgttattcactttccagaccatttttaacactaaatgatactatgatgatgaggctcatgcaacagagacaaacaatgattcacagttctttcttttcagctgatgtttttctctttcatcttgaaaatataagaataagtttcttcgatctttgcatttagcaaacactactttcaacataaaacagaatgttagacaataagagtgattcggttagtgtgattcgatgtataattccaatgcacttgatagtacagctttagcattgaataaaaatataaatttaatgtaatgctttatatcatgtgtaatgaacaagtcagcaagtagcaaatgaagacatataacgttcctctagagtctgagagtttaaaccttctgtaacaaggggtgacactctttctacttgcaaatttggtgcaaacacttgatttgtcacatcaattttggaattattacagcacagatcagtaaaagtatcaatatcatctcttcgacaaacagatttaagagcatctaatttaaatgtctttatacaactcaagcccatttcagctgccaatttctgaatatccagcacctagacagtcatcaaaagttgatatgttaacaaaccattaatttattacaactctgcacgccatttaccattaatttatcatatttatcataatcattacaaaataaccaatattcagtgtatcaaaaatagggtacagaaatctggccaccaatgaaacttagaaataaatcagaaaatagaacaatatgttaatgcatgttaagctatgattccacaacatccagttactgcagtatacttgagttcaaacaagcatataggaatggcaagtttttgctaagttcagcatattcaccttattatgagatctatctgttgcaatgatctctccttcatccttcataagtattgcaattgcagttgttttccctccaggtgcagcacacatatatagtatccgctcacccttttgtggatctgagtataaaaaaagaatctatataaagaaaaaaaaaattacaaagagatgagaggataaggaatcctcaatccttcttaaaataagaacaatagtaaaacagcaatgaaaagagaaaaaccaatagagcaaagtaaacaattattgtcattcagctttatcaatcacatgccagaaaatctaaattagtcagtagcggatgagaccatagcaagacctatccctgactaaaagggcatattttgaggcccacatgcttgccagaaaagcattatactatgacggttcaaatccaacttctctcagttgtgttttaatctggagtgcttgcagaagaatatagtaaaatattatttactaccaaggaaaacaaatggccaacaataacattgcatgtaaatcactccaaagtcagaaaataagaaatgagactctaatttatgtaccgaaagcatgagcagcaataatacttggcaggttttgaagaaatatttctccctcaagcacatctggaaaacagaaaaagaaacaataacacatcagctatacacatgcttcaaaactaaaaataattcacaaaatttccaaatagataaagagagcaaagataaatggcactcaggggattaacccaggagtgctagactatacagagtgggggcctctacagagggaaaaaagcattaaatagatgaagaacaaaacaacaaataaaagactgcacaggcagaccagaaaaggaccatatagaattacataagaaaactctggaaaacaaaatatccacagcaaccagattctatctcacctataatcacaaatctgtaggcttcatacaagctacacaagtctctaccccctccacttaccaagtgagagaccatgtcaaatctaatttcttaaagataatctcctcagatatgtataacagctgccaattcttatatatgttttgagcaatggaaaaagtatccaaccataaacacttgctaaaactcctaaagaatcaattattaaaacaatatctaatgttcttcactaacattccaaacagcaaaagataaaggcaaaagttcagtatacgattccaaaagcagagaaacaggtttcaacactccttgatcaactcgatactaaagcaacaatcattatcaacaccaactaatgagattatagtaatcttaaactaataatgtgttgaaattcagtagatcagagtaaagatgtcttccttgcacaaatttattcggaaaaaaaaaataactttgtcatgctgcattatatcacaccataaaatttcattcctagatgtgtagagtaattataaattcgtctcaaaagataaaaatatcgctaatgaaagagcatggcacattagagacaaatttatcaacactctacatatttaggaacgaaaataactacttatccaaaatataatttaatcttatctttcctcattttttaatcgttgcaagcgtaatagtacaataaacacttaaaaaaataaacataagttagaataaacataataataaacataatctgtatgttgttctgaaatttctatcgtgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgattaaaaaaatatcatgttttgaagggactaaaagattatttaagctgcagaaatagatttcgttcaggaaaacatactgataccaatatattaatggaactaggcttatattttaatcagatttcaagtccaagttctgtggattaaaaaaatatagttgataaaaaagatccaagtataggtggtcaattaaattcttaataaagattagttgtttttaaagttaataaatatatcatactaattaaatagtgacaaaaaataaagcataaaaatattaagtttacaatatgaataaaatatcaatctaacatattatacctccaactcaatgcttccaatttttttgtgttaattatcctgttcatcaagagaaagattttgactaattcgaaatttaaccaaaagataaataaaatttggttaataattatttttgtcaagattaaatttagataatatctaaataattcaatcttaatttaaggatatttatcacttatgtctaatcattattgatttctgtggtagaattgacatgctttttaaaaaattggctccaatcttgcaaaatttccaccttattctccgctgattttgctgaccaaactatgtacagggacgagttcttaaccttgccatatttggatttttttttttcttgaaatagtagtgactgctgcagctttgagtgccacttacattctaataactgaagttgatgttcaagatgtcaattctctgggtcatgtgctgtatacgagaacgagagagttaactgaaactatagtctctagttgggcaattcaatttaatgatggaaagaaatggaaatcaaacaagtattgatcgtatttataggataaaaatgaaataaatttagtttgttgactaattttaactgccgtaactttaggacataaagagttgattgaatagatagaggtaaatttaagttgtgataaattacaattttttatacaataaaaaaaaatcttcgaacaaggtcagaagggtgataaatattaattgcgttatcatgtgttcttctgttccagttaagctgatgtaatattttgataaattttccatttatgaataaaactagaaaacgacttcaaaacaacggttaatagcggactcattcaaatacgtgataagaataagatagagtagaagaaagacagacattgatcgtgttgtctccacatagatagatagaatggcaattttcatagtccaagcaaatacaatatgctttgacaaatgagatcaggtgatattcattactcatgttgtgggtgtttgattctatgaatattttctattaattcatttgtagatgtcatctcatcttttagagaaattatattaatgtgtttttaaaaattaactaataaagaacttatttttgtttatgaaaaagttcatctcattttttttataagtgtttctaaataaacttaccaaaacatctataataatagttactaattagattaatctctaggtatgttggtagtatttttttatagaaaagattttattaagaaaatactatatagtatagcctgtaccattaatacaacactacaattagtacaagaaatctacaacaataataaatcaacataaagtagaaagtaattgggttgggtgtggacgtcgaataagacgtggttttggctaaaggttccacaaaccactattagtgcaagtcacaagtgaaaaactagagaagacaatagtcgtacagttagatttcttttatttaattcttcacggaaagtgtcactacccactagtgaaatgattttcgtgtatatttttctttcattttaagctttgtgacactcaaacccacacgagtcatgttatagtgcacatctatctgatcgatatatgaaaaaacttggaagttacacagcataaacatatttttttttctgtattcggagtgaggaagtatcacgtggaagaaagattacaacatggtacagtaaaatccaagaattaataaatggaagagtctatcacttttcaaagtactagtaacctcttcctaccccggcccggataaggaaaaaagacactaatttgatgttgattcttggcacgtatgtttgcatcgaatttcaacaactatgctaatttttctatgatctcaatgatccttcacacttatttgcctagtgattgagatttctggggtattaacaatcagttccaggaacccattttgcacgttatgacaccaaaagcacgtattcacatgctccaacgagaaaactgcctcattgcatgtgcagccacacgcatagcaatattttttctatttttatcaatcctataattttcagacaattaaaattaggcacacgccatatattccatttactctcttttcttttacatcacattaattattgcatccgtaattttctcttttcagatcatttcactaagataatgatatgttagtaatagtagatacaacttgtataaattttttttttgaagaatatatttttcaagttgtgataataaagattttaataatttaatgttacacgatttgataacgatataaaaagttaatagtatgttgaaattaaattatttttttacgtatctttcaaatgatctttttaagagaaacttattgttactagaaaatgttttatttaaataactttgaatcccttaaaaattgtaatttttattatatatctcttacttaaattttttcctacatatacctgtataaaatatattttttgtctacaataaattttccatttattgttttctcttgaaccttttaaatatcaagattttttaaattttgttattttaaataattaaataaaataatgatatttaaaagcaataaatgatatacttgtaatatttaaaagaatcaaacaaaaaaactatatacctaatagaaaaaaccaacaaaaaataataataaaggaatcgtttactaaaaatacgtttttattaagaaatcgttttaaaaaattaccatgaggaactaagcaagaaaattacacatttttggggccctccctttggcctctactaggcacagtattagctacactttttaaaatacaaattcaaacccgataaaaaggggtcgataatgatctcattctcctgaatcactattatttactttgtcaacaaattctttagcattagttttcattatttaagtcacaaaggtggacttgtctttctccatgctccgttcaattacatgacgactggttcaaaactctgacagcggctagagagttttaccgctccaattttgtttttttggatcatgatttatcaaacaccatgtctttgacttttgctagttgcagccttgcgaggcaaaagttatatctgtgacacaatcacaagccaaggaagcaggaaccagagaggaaaatcctgtgataacaataccagaccaaacatcatttattatttagacttaaatatgatttatctctacgataattattttgaatttctgataattttttgtattaaatttaagatagtaattatatatcaaaaattttattttaaatcactgcgtgacacaatctcaacagataatatatcaaaaagatttgtcatacaaaatgtaatgtctcatatatattgaattttaaaaattgtttctaaaattagtataaaaagacgcaaagcaacaaattttggtgttaagattgatgcacaccagatacatcctaggtcaaataagtgtgtgtttgaatagaagattgcaaacctagatttgtagaagtatcatcactcttatttttacttttaacttacttttatcaatctagaagtatcatcactcttatttttacttttaacttacttttatccattaaatttacatagagtccacacatcatattttcaacttaaatccaaacacactaaaaaactcggaatgtaatcctaagtctcttcttgtgaagtactgtatgtaatcctaactcgaaggtgtaaatagtttgaaataatgctgcccgtgatgagaaattcacttcaaataagtactatatgttttctttatttttaaaaatggttttccaaaataaaaattctacacaatctcttttattagaaactttataattcattttaagggctgataaaatatgataaataataattagtgctttaataacattggttaaagaatttaaaatcaaaataggggcaaatacccatataatttcatatatctctttaaaatattccaattttaaaaaaaattggatagacaaaaaattatattatccataaattttcttataattttttatgatttatataataaatatttttaattttaatttcttaatcaacgagagaaactcagaatgctgatcaccgaaacccataaaatactaaggctttattgtgaataaaaccgcgttcttgggatcaacctttgacattaggcttccaagtctttctcattcgttgttactaataaagtcacaccaccttgcttttcaatccttctttcttccttctctccgtcaaaaacaattcccatctgccaaaaccaatgttttggcctcaaaactcataagttcacattttttttcttcatttccatttactttgccaatccctcatcttcattcattttcctcttgttttaatattttgcttctgattgattacctttgagataaacttgtgaactcagttctttctttgaccctcttggctaagctcagaaatttccataaagaaatagattttctccctgaaattctgttaggtgcttgatattggattttcattgggtccaagaaagaagatatcatcgttactatggttttgaacgtgtctctcattgtggttctgcttgtgatatgctcctgtgttgtggaagccatttctaggaatcacaataatcacaatcacaacaatatcaacaaaaatggatcttctctggctgccataaagtttcctgatcatccaagtttcaatgatgtctcttcttctggggacaatgattgtagcttctcaaattctgagcaacttgggcattctgtacctaccaggacatcaggtgaagaaactgatgaagagagtgaggcttttccagcaccaaaaccacacgagaattcggtgaaactccacttgaaacacagatcagggagcaaaggtgctgagcctaaaaagtctgttattgattccacagtaagagatttcaccagaattcagaaccttcacagaagggtcatagaaaagaagaaccaaaacaccatttcaaggctgcagaggttacagaaggagcaaccaaagcagtccttcaagccagtggttgctccggccgcttcaccaacaagtccagtttccgggcagcttgtggcaaccttggaatcaggggtgagtcttggctctggtgagtacttcatggatgtgtttgtggggacaccccctaagcatttttctctgatacttgacactggtagtgaccttaattggattcaatgtgttccttgcattgcatgttttgagcaaagtgggccatattatgaccccaaagattctagttcttttaggaatataagctgtcatgatccccggtgccaattggtttcatccccggatccacctaatccttgcaaggctgagaatcagagttgtccctacttttattggtatggggatggttccaatacaactggggattttgcattggagactttcactgttaatctcaccactcttaatgggaagtcagagttgaagcatgtggagaatgtgatgtttggatgtggtcattggaatagaggcctgtttcatggtgcttctggtttgctaggattggggaaaggatcgttgtcatttgcttctcaaatgcaatctctctatggtcaatctttttcctattgtcttgtggataggaatagcaatgcaagtgttagcagcaagttgatttttggtgaggacaaggagctgctcagccaccccaatttgaatttcacttcttttggtggtgggacagatggttcagttgacacattttactatgtccagataaattctgttatggttgatgatgaggtgctgaagatacctgaggagacttggcatttgtcttcagaaggtgctggtggtaccataattgattctggcaccactttaacatattttgctgagcctgcttatgagattatccaggaggcttttgtgaggaaaattaagggctatgaacttgttgaaggccttcctcctctaaagccatgttacaatgtgtctggaattgaaaagatggagctacctgactttggaatcttgtttgctgatggagcagtgtggaattttccagtggagaattattttatccatattgatcctgatgttgtttgtttggctattttggggaatcctcgatctgccctttcaataattggaaactatcagcagcagaatttccacatactatatgatatgaagaaatccagacttggctatgcaccaatgaagtgtgctgatgtttaacatttttttggggttgaaacttgaaaggtgtatactgtatagtctcataattgtaaacacggtgagtcagggggtagattttttggttttcccttaggtagaaattggaaagtgttatacacaaaaaagaaataaataatttaaagttgattatagaactaggttccaggtaattacagaaaactggatcattacaaacataaacatttgttttgtacacattttaactgctcaattttgagcttatctcatttaattttaatatttgttctttctatatatgaatatatgatgttctctcttactatcattctggacatgttattgttttgtatattcattatcctcaaaggaaaactgctccgtatatatatatatatatatatatatatatatatatatgcacacacatacaagaaataaagaaacttggcaatgaagttctgtatcctgagtctccaagtcaagggggcaataacagttcgtggtttgctcattgttactatcctactttcttgtagactacatcctttaaaaatttatacttatttcctcttttaaaatacttttaaatgaaaaataaatcaaatggcagatggacatggtcgtttcccatatgtcgcatcagtgtattattccatggcttttctgttaggatacactgccaactttataagaaaaaaaatgcatggaccaaagaataggtcaactctattgttggcctaggtactttgacattaatctaaagaataatactacctacacgtcaattttatatgataaattttgcagtttacaagaaaaggggaaaaaaagggaaaagtattagggatcacaatccttctgcccaaggatgtttctctgtaaccaaagaattaaataagacaagttatgtgataaagaaaaacaaattataagaagtgttataagcattttattgtaagtgtattattgctataatctagctctctcatttctttctttctttctttgtttttttctttttctaagagttatatttttttacccttaaaatagagtttttttttaaatctttttttgtttttttgtttttatattgtgagagacgtttttccttattatgccgttatagtaaatggtaatgtttataggaatttccaaagaggaaatagctccatcaatgnnnnnnnnnnnnnnnnnnnnnnnnnnnnnnnnnnnnnnnnnnnnnnnnnnnnnnnnnnnnnnnnngtacgtgaattgtgatacacttacaagttacaaccactcatacaactctctcgatctatgacattattcattatattttacaattctttttcttttgtactatttgttgaatgagttgttatacaaatattatttctcaatcaacaatagtggatggtggaggttggtgagtccacaatatagaggacggatttaaagtgtatagtttgcatatgctccggtgtgggtattgtggaccacggatttaaagtgtgttatttgcatattttaaataagtaattatatatgaacacttgtatatcaaataatttattaatatttttttcttttatattatatcatttgacatgtaaaagaaatatcatatatacactttttttttcactaggaggtggcatataaatgttagatgtttatgaattattgtcatacttaaatagctctgcccaagaaattcaaaagaggcccaagtaatttatttttagacttgatatttttaaaaacctatcttgcaatttattattttatttaaaagcttattttatattaaaaaattataaactgtaaaaattaaaatcacgactactcaatacacaagacaaatgtgaaaataaataggttagactttataagataaaatatgaatcnnnnnnnnnngaagcacatgtttggtttggatgcgtttttaaagagatgattttttctataaatcctttatagaaaatttgtaaaagatacggttttatttttaaaataagctgaacttaaaatgacttctaagttttaattgccatagtacataaattaaaccgtcaatctcagtaatatttgtaaatttaccttgtgaaaaaaaaaatattggattgattttagattgtaatttttttctctttaatttctaaggaaaatgatacatatgcccctggagaattaaaaaaaataattgaatggctttatgaaagaaaaaaaaaaaaattactgttgagagtgttagtcaaatgtaaaaaatggtcaatctgagcctggggtttcagctgggcccaactaaggaaggcaccggcccattagggttttagtttgcatatatgatcctttgttgattagctcgtagcagtggaacaacagttgacagaagcaatcgaaatcggcggagatggttgccatgagggtgggtaatgttaatgttaatgttaatggtttttgtgtttgatttagtttgcagggtgagtttgtggaatttaacatgtgaatgtgattatggttgaagcagtttcaccagtaccaggtggtgggaagggctcttcctaccgaatccgatgagcatcctaagatctaccgcatgaaactctgggccaccaacgaggtccgtgccaaatccaagttctggtatgtttattgttcatctctatttcaaatgttgtttattcgtattcgtactaattcaataataaaatgcagtcttttctatttctgatttattgttattattattgacaatgttaatgttaattgtttcaggtattttttgagaaaattgaagaaggttaagaaaagcaatggacaagtgctagccatcaatgaggtgtgcacttctcaattttactagtatgtttctgttcgtctcagaaatatcaattattgcactacaatgaattacttttgagcgctagttacttattaaaatgattttaatgaggctagatttctacgttgaagaattctagaggatttttcttttttttttttttttatataaatatgatactgctgggcttaacttgtgcattaaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttatataaatatgatactgctgggcttaacttgtgcattaaatttgtttaagttatgtagacatttgaagaagggtagacataatgctacatatagagaccctgttaggtgtggatttgactacgggaagtcatttatgcttaacttacctatctgttgggtagatcacgttatttctctttttctgtttttatttttattgactatggaagcaaatagttttcttgtcaatttttgccaccggtatgatggaatctagtggcgtaggtgtaggaatgtagataaatggagtgtactcgagtcatatggtgcattatttctgactaacaacctaacattagcacacaggaaatggtaaatgaggtgaaaggttttgaagtttggacatttggtgaattatgatcttatgaaagcccctttaggaaagaaatacttgaacaaatatttgtgttctaggttccaattgctgtcttattggacaatggacatggaggtttgagtgtttgtactgattgcagatttttgagaagaatcctaccaagattaagaattatggaatttggctgcgttatcagagccgcactggttatcacaatatgtacaaggaataccgggatactactctgaatggtgcggttgagcatatgtacactgaaatggcatctcgtcatagggtgaggcatccatgcatccagataattaagactgccaccatcccagctaagctgtgcaaaagggagagcaccaagcagttccacaattctaaaatcaagttcccattggtgttcaagaagattaggcctccaactaggaagctgaagacaacatacaaggcatccaggccaaacctgtttatgtgattcagttaatggaatttccctgcttgtttgattcattaagtataaaaaggaagagcttagaggtgatccatgcagtgacaaacttcgttgcctgcaacatagtttgcattctttcaagctctggagattttgtttttgaaagatggtgttttatttaattttatatttttgcagagtaatctattttactcattctgatgtattcgataaaggttgcttttgaatttagcgattacttctttgtttcgattctgggtttatcacttgttagttgatatattctctctgatttttggtaataaatattttagaccaagcatggctaatgaaggacaaagctttaagtgtataaccttgagtgttttttgtgtttttaaaatcatattgaacttttatctcaaatttctacattgatttttaatgccagactatttatgttactgaagtgaaactgcagaaaacactaaaacaccttagcaactgcacctaagttttgtttgtcaataaaatttatttctttggaagaaagacgaacaaggcatgtgttaattcagtcattgccgcttcggtttttattttaaacttcaagtagggcctcacttcattactatttattatctagcttattagggtagaagtaacaacatgaaatttaatgttaaattttaagtaaaataattaaaataaatgattaatattggattttaataaactattttgttaagttgtatgacagggattaacttatcttaaaagtaatcaatattgtaggctggataactattataaatttgttttaagattcttttacgtacatttacgcactcttcatctgtatcttatgattagtgtgtaacttcttttaaacgggtatactttgtgcttgtgcatactcctgattgatgacgaactacatcatggtgttagtcaaaattaaatcgttgcaatttgctcactggtgtaattaaaaaaagcttttgtattattagtttattaacttttgatttttgttaaatgacaaaaaaaaatcacttggtaacttgaactagacatgtttattacttgctgcacaggattatcctgtcgctcgtaagcgaatttacatttactaaggaacacaaattgaagaatgctataaaagtaataaactaagttagtaataaaaaaaaaataaactgattaagcaacggtgaagggttaacatgagggaccacgtgcatctaccttttacggttcagcattagcacttgttaattattctattcccagtgtgcaagtgcagatataattttaactcacaatgacaaataggttatatgagttgtgactgtctctatttactgtgttttccatatcccataatcatatttgtgacctaccattatcacgcagatgcaagcatgagataaaaatataggaaaaataatactgaaaaacttctaattgcaggtctggtaataattagagggacaacgttgaggttttggctcaaaattttaaattatgtgaaatgttaagaagtaatcacaaagaaagggctgatgattaatttccttgagatggattggtcgtttaaaatatggaaaaatattaacctcgaagctgcatgaaagaaatgtgatttgatacgaacaacaatgccatgtctaaaattgttaacatttttttttaaagaaaggaaatgacctttggtagagtttgaatttattcacttacttttaatgttttgttcaagcatgttataataatgtgtgttgagcagtgggaaacagaagatagtgtttaccagggaagtctaccacgacccactttgtcttttagaaccctccatcgaaatctgacatacttttttcttttttctgaaactccacattctccaccataaacacaaaaagcttgtggaagttaaccccacaaccacaagtttgaaatctcatttcgttatatatcccaacaccccactttcataatcatcatttttcatgcaacaaccagtgctatttagtctattattctaacttcaaacagaaatatataattttgaaggttaaaactctatcttttttcggcttattgatgagttctctctttgcttcaagttggtctcattctctcctgatttggtctcaactttttagttgtgcaatctgagaagaaaggtaagagtgctatgaatcttcaaacacacatacacatatagagtcatgtatgttaccttagccagcttgagaagaaacatatacaaattccagaatgtcagtgtttctgccttgaagtcttattcactggcagtggagattgagttggccatcatcatattttcaataaaagaagaacgggagttcagcaaaaactcagttctttcctctttcaattaagtattgtttttatcaagtttctccttgttagcgcatctcaagagcacaagaaagctaaaggcagacattcaagcaaaaaagaccataacatcaaggtatttcattcctgcatggcattctttctaattttgatcaattaagttggtattataattttgtatattcttctccttgtctacattgctattataatcctctattaagttttgttttgaagttacctttttattgtggttgttttatgtatgaagatgagtgctagacttcagttcgaaatcacactagctacatgggtttctcttgtgggcttcaatggcgttcttaatgcctattggtatactagtcatcagactgtccaacagagaggggaatcaaagaagacttattattatattttatgttcatgcagtttcgcaggaaagtgtatctaaacctaaaaccgatcagttacattataattataaatttaaatcatagatcacaattttttttgggtatatttaattagtttcttttccctttacttggcaacccatatttgtacaattatttatatcgtttcagtttagtttagaagggtcagttgtcccactcattaacttctaatgatggtggaatggagataagaataacaagattccaattttacagttaatttgtttgtactaaagcttattagtcactacataaggtcaagtgaggggtattgcatctttgtctattggaaaggactataatgaatggtttgaagacaagaaagaatctttaagaaataatcttcttggttattggaagttccaagctttatttgtctcattttttaatagagcatgtgaaaagaactatgcaattatgctgttgtctgtatcattaatcaacttttagctcaacttataaaaaggccagaagtgaatgtacctctactattaacaaaagtaaataggtttattttaaagctttcttttcttgcattgatccttgccttttttattagttatatgcacgttttgtatttctgttcaaaagaagcttgccgtacttcttgccaatgcaggaacaatcatgtccataaaaaatttcaacaactccttcagcaataatcatcaaagattaggggtcgcattatatggtattatctggctgcaagttctaattggtatttttcgaccacgaaggtgaaccaatgaattgcttgttattaagaaaatctatgcaatatattggattaggccatttagcatttgctaaataccaaacttagacaatgcagtcaaacttttcttctcttttaaatttataaagatttttcatgttctatgttcatattttctagagagccagctttattaacagctacagatttctgtttgcgaagcatgatgattagggtacaactgttttcttgttcttcgcaggggatccaaaaaaagaagtcttaggttctatgcacactggatagtgggaactgcagtgtcattactgggtgtgctgaatgtatttataggtttacaagcctaccaagaaaaaacatccaaaagcataacaactaggaatatatttttcaccgttcagatatctttgattgtgatattctaacttcttcaagaaaaaatgggtctacatacaaaaccaaggagtgatttgggacaactaactactgattcctacttgataagaaaaaaaagctagttcaaatgacaagaatgcaggcatgaaggctgagtcttgctaagaaagatgaatcaatgccttgccatggatgcaagtatttgaaacacataagaccacagatggacctcaattgctttccctaagataaaatatgtttgtgtgggtttcttttttcagagaaggtacagtcattgaaaactttgtaatatcttcccgcgagatacattttttttgttgtattctcctaacaatcaattctgatatttttatcaaaccttgatgtggacgctggaatacttcatggagatagatcaatatattatccatgatgtttttttctatgtttgaggacattgtttgtcagtgtttataagcatttcaaaataaaaagaattagctaaccaaaggggtaagacagacactctatcactaacacaggagaaaacaaataataaggtaagaaattctattaatatcacattgatatatcacttaagtatcgctaactatagtatttcaaggaaaaagctgtacataaccggttaatatagctattcctagtattataaaaggtggaagaatcacaaatgctcctatggttgcaaagaaaactgaatcattcctttgagacacttcattgaggtaaccttgtctcttgatatttctcttttgtgagatggtcaagaacttcgcactcgctttcttcaagtttttacctaggggtatggtgaaatcatcattcctttctccaaataactgaacgagctgctctcggattgtaagtttgcttccatcactttcataacctataaaccagaaaggttgaatctttgtaatccttttcccaatattgaaaaaaaaannnnnnnnnnnnnnnnnnnnnnnnnnnnnnnnnnnnnnnnnnnnnnnnnnnnnnnnnnnnnnnnnnnnnnnnnnnnnnnncagacatggctataaaatttctattctttcacataactcatgagacaaacatccatatcaggagtgattcataacatagagataaaaggcatgggtgaatttcaaaagttatgcaagatggggagaaatagacatatgatcataccaaaaatatggactttactcttttaaagtgagacattaagggtgcatttacaattgatttgaatccaaataacttgtaaacttgagccacttcaaactaaggataaatacatccttactttctcactctacattttttcttatcttagcggagtcaaatatttactcgattttcaaactttcatgctagctatttacctcccatacagctaccactgctaaacacattatctttgatgaacaaatcatattacaacacccaaattctaccatgaatttggtctatgctgagtagtactatgtgataccaacgttattgtttctactctaaatgttttatactatgcggccataagggggaaagataaggtaacatcaaaggcaagctctttcatagtatcattgaaattttaagatatggcagcaacatataatcttgtaacttgtgatttcaaaggcactactcttactttcaatttttttcccattaaaagtattaaaacaattacattctccagccatgtctatatcttcagcatatttcatttaactaacaagttaacaacaaaacagagaaggggtttctaacagtgataaaatggccttacagaaacagaagacaactaatctgtctcccctacacgtatcattgatttaaagaggacatgttagcttacgtaccactattaggtgagcttgtagatgtaagttgctccaaaagatccagctgtgcacgagaagaagataaagatcctaacaacacaaagtccccagaagccaagtcagacatgaaggagaacctcatattgtaaaatttagaagtatttggtagaaatttaaactggtaagataaaaaaaaaaattaagaaaatttgagacagtgaagaaatcaaacacatgactttcctacaaatatttcaagtttagtagaagttctgattcatttttccacttgtaaccatgtggatgcaacaaatattaaaatataactgacataatgtctcacttttctaaatatttgttgtctcccaatcatcaaagaaagaatatattttttaagatataaatcaacaaccagtatttgttgtattgggtcggagacatgcatatctttcaacccacatgatttagagactaatcaattactaaatcattgatccaaaaattttttacacacagaattaatcaaatataaattcttccgttaaatgaattattctcttacaggtgaatgcaattttaccatacacatatggttaatcaacaaatatggaaattcatggttatccccataagcccatatttgattcaataataataataataataataataataataataaagagtgggtaggaattgttagcgtatataccattagcagcagaagcatcttcctgtgtaactccagtgtcagtcccttgtgtttgagcacatgttgtgagtaaagaggaagaaggatggtagaatttgatgaggttgttgtgtttatgggtcagaaaagaaggcttggagtgaagagaagcagtgctgctgagattgatggccataaagtgaggttttttggagttagttgctaatgccattcattttgcagtttcaggtcggtattttaattggccaaaggcggcacttccctgccacaaatattatctgtggaggattctacttctatgtaggaccacaaaaaaatcattcttctaaatccccaccgttcaaaaatatttttctttcactaaataaagacacaatatgtaattttttattattggatcattcttataaaatttaatggaaaagtttgtttaaacttatttttttaaaaaaaataagtgttcatttaaataaaataaacagttttataatttttagaaagatagaaatagatcaaaatttatctgaagaaaggtaattaaacaatacttaatgaaatatgatataaattgattgtgccttagtatgaaatggaaaaaaattaataagtttagtagaggattaaatttattattatctttatgtttcaaataatttctttttagtcatcttttttttatctctcttttttttataacctttttgttaaattcatatatcactaaccctaattaagtttgattaaaaatacttgtgtgtatgttaattcattcatgagattctaaacaaaaattaaataaaaattattcattaatatgtattgataccaagtagaaataaagacacatttctcaagtacaacacatctctcaagctgcaacagtcccagctggtactttaaggctttgtttgggagttaagaggggaagggaaggaaagagattcaagggaaagagaggggaaagaaagagaggaaaatgagggaagttcattcctccttgtttgtgagttaaaaatatattaagagaaggaaatgaagaattaataagatattaaatgtgaaaattatataatttaaatataaaaatatattaaaaatatattttaatatatttttgaacgtgtaactggggtaggatagtaattttaattacttttccttcaaaaaactcccaaattgggggaactacaatttttaggctttggaggatttgagaggagttttaaaaatcctcaaatctttttcctcaaaaattaaaactctcaaacaagaaaatatctctacctaaactttttcctttcctcccttcttctctaaaattcctctcccaaacaataagttgtctatcaccttttgtggggtgtttattggatcggatttatctcatgaatcccaccatcaaagtcaaattaaatcaattaatttgaattttgaatttattatttttcaattcgaattaacttcaaccaattaaaaaaaaaaaacttttaaattaatatattttgagatagcctccttttaacaggtccatgtcaatcactcaaaacaccaccgatgatcagagagctgccttcaaatccttacctgcgttgagagacaacaaattaacacattatcataagctttcaatactaatttaagttaggacttgtttagataaacttgtttaaaagaatttttaaaagaaaaaaataaaagaaaaaaattagatcaattttttcgtaaataaaaataaattttttattaactaattttcacaaacttactaatatagtttctctaaaaaataaaatgaaatttacaaattaactaataaaatacttacagagaagttcatttcattttttttcttctaataatatttctaaacaaatttacatccaaatatgtccttatttcttatttcttatgaattagatctacaccggaatggtcgtccaatgacgcagcagcagctttggacggtgtcaagtctatttttaactgtttctctgtgtcatctattttttgcctttaattgtatttcgaaattagtgtgtgtatgagatgatatagtcatatagccccgtttatttaaatttaaatttatttgttaaaaaatattcttttaatataataactagttttctgtttcttttatgtttgtctaattcacctttatttttattaaaaaaaaaagcaaatttttgtttttttgataagtaaatcttatttatttcttaaaaaatcataggacagctatacattgacaattaagtgccattatcagacaaattaaaaatgaatatgatacatcttaaaaaatgaatttaatacaaattaatgagatcatattgcaaaccttaagtttggcagatcagcgattccaaaatgggcaatggaacctttacggtatgtcttttttttccaaaattcatgcagttgacaattttaaattgtaaattttcgatagagttaaaccagtagtagcaaataaaagactgtttgaaactcaaaatgacaatgaagaatgagtttgaagattctgaattataaaggaaaacaaataaatccgaaaaggatttggatggaagctcgcaacgtgatttgccttcaatgttaatcgggcctccttcgcaacttcttttaattttattttaagcttcactttaacacttaacttcttttataaatttaaattctccaacttatttcgtcttatgtttatttttgccgttactttttattatgacacaggtgaacattgaactccctcagggccacaaactgaggtactcgaatttttatgattattggcaatttactgataaaaaatcttaacaaccatttcatttgccgtcattatttgacagcatagcagttacattacccataccttgataggatcttctagtttacataaaagataaaagacttcaattttaacaaaaaagagagattataagtcataacgtgaaataattacgtaaaatattgcgaagctgcaacaaacttgttgagaaaaataaattaatgaataattagataaagatagtttacgctatatatgaagatattggcagacatacgtaaggcatgatgaaataatcgtttacatgtctattaatcatggggagtatactacagcacttgtttctacattccatcaaaaggctttatttctctacattgaaaagtaacaacaaataatcaagaacttcgagattaaccaataacaataatttcatttaaaaaggaaaaaaaaaggacggaaaaagatgaatagaaatgaaaaaaagaaaaaaatatattaaatcatttaaatgtttgtacctcatgcttgctagcagaagtagcaggcctcttcctcatgtttccacaagcaaactcttttcaataactttcaagaagcaatatgagaagtagcagatgtggtttaatttgctagactacattttgtttactggatcatgactttgaggaagtctgatctttttcaatcaaagaagaacccaattgaagcataagaggataaacagggctaaactccttatctcctctgctcctcacatttgcagcataatcatcaagtgttgctttgatgcccttccagatttgatcctcccattgagaatctagccacagtgaatactgcaatggtgttagtttgttcctttgcagcggtgactgcaattcttcaggagcacgggtatacagatgatgaagtatgacatttggtggcagatcttgaagaagtggtgatgatgcaagctgggacgtttccaagaaaataagcggacgaaatgctctaagtgcacgatatggtgcacccagttgctcaacagggaacaaattttggcccacagctagctccaattcagccatatccctagccatcctcaacttgcctgattctgaaagtggtctcacaagagatgcatgtcggatgaagaatattagaacacgtgaagccatgctctggacaagcctggtgcatatgttctctgtaccaggagctgttgaattcctggaaggcaacaacctagaaagaaactcactgcgaaagtgaagaatacacttctggagttcctccatgtaaggtgatgcattgttgtccatagcagcatccattccgagcactccaaagttatgatcatgtatttgtaatatgcaagactcaagacgatccagcattgcctggaataaagctgttacagaatcacaggcaacaccatatatggcacctaatgaagcagacaacacatctgcagcaatactgggcattcctttaagtatagatgatatctgtgtatgaacatcttgcagatgctgacacaatgtaaagttcttgagctgtgctggtgttgcaggaccatttacttgacgtgattcaggaccagtggatatctgtcataacaatgacattgaacaattaaaagattagtaactatgcttctatagtagtcatcctcccttcacttgaataaaatggactttgggattctatatattgcaaaactcatacacaaagaagaaggggaaacaaagcctttaggttccagagaaaacatacagcaacagcacttcaggtagtaattatctatctccagtcattatgtctcaccataccatgacaagtgaccacacttcaggtagtaatattggaaaaatattatataagtctagcaaaaatattaattactcaacacactgaaaaataaaatgagcacgcaagttaaatgattgaatggttgctgatcactacaatgtgatacagtacaagtccaataatacaatacacatatgaagtataaactcctcaatgaaagaacacgatgttctttatgcatgcagttaacaatgccataatttactgtgcagtcaacaaaactttccttcttctgtgaatccattctttccttgtaataaaatattctttattccaaaaatataagtagttatataacagctaactttatagcctgccgtcctgaaaacccatgatctagatagcattgaattcatttctaagccaataaatgtagtgcttaaaacatctaataagcaacaatgccttagatacaataacgtcatttttgtttacctggtattcagctcgttctgcaagaagaatcaaaaccttgccaatttcacgcaaaacaagaagagttaagcgtgcatccatctgaacagtttctatctcttcctgaatgcgtgatataaatcttgatatttgttccttggagggaacactaccacgactggacattggaaatatagaattcactagatctgaaaggcgactcaagcaatgagccaaaaatgcattctggaatatttcaacagctgaaattatcttctcttttccagacgaattgatagctggtaacactcctttgacatctgtgtcatgtgaaattctttcaagtagattctctatcatggagtaaagctttggatatcccattgtaaaaatctctttaacaaaacttgatgcagtgaaagcagacttcatttggcttgcaaaagcctttgtaatggcctcccacactcgatctgttagcataggatcaccttcctatgccgcagcaggcaacatccaaaaatgagataaaaaaatccaatagaaaataagaaagtgtgaacaacagtagctagaatatgtatgatctgatgagtgttcctaggtaagaactcaatactgtaaagtataaatgaagacccaaatccctaggaaataggaagtccattgaatctgtttatttgcacattgttaagatcacaattttttccaaaatctaggataaaagaccttactaaaaaaatcaatgcaacttcttcatacatctaaaatattgatcactttattacactctgaatacatacagaggagatgattttcaaaagattgcatattgatctcattgcatccaaaatccatctagcggtgtttaatgcatcagaagagaatggacaggcatggacttttacaatttctctactctgcatcctatacaactcttttgaagagagaaaggcctttgacaatataatgtggcataaagctggaagcctattaaaataattctacacaaaagagaaacaacaagcaattacccttgatctccttactccctcttcacttatgcataggtaatatagcatagcccaagtcaccccttggcatctgtttacagcataccagaggaaaagaagaccacaaaaaggaaagatttagaaggctggcaaatggtttgtattgcacagcaaatacttgattgatactaaaaaattgaaatattacagtcttgccttcttgtggtctctaacatttatagatctattaaaccagtgcaatagattcatagatcttgtcatgtcagtctcttcaaaaccaaatgaacacacgtaccgaaactagcaattaatgactcaattcaaacttctaatataatcctcagattcttccatttgggaagagtgacacacaaaataatagctctcaatacactaataaaatcgggtgtgaaaaactaaaaaaaaaaaaacctgtttgtgctaacaatttccaaactaattactaatattcaaacaccaaagtttggctggccattttgcataataagctaaagctaagccacagggtattcgttacacaattatgtcggtaaagtaaaccaattctacgagagaagcacccccaatataatcaaaatactatctatcatctacatatcaaactatggcgttcagaggacaaacaataatttctattgtcgtgtgatggacgcagaagagcatatatgaatccaaggcaagcaacaacataatttccttctgatgtaaacaaacaactaaaacaaaaacaatgagcctcacctgaatgacctcatcaagcaacaaaacatgtgtaaagggatcacgttttttagagagcaccctctgcaaatgccacacagcaacagcaatggaatgcaactgatccatgcaatttcccaacctatgccagagagcctctctagctttagcccctcctccaatgtggggcgtcccagagcccctaatcccaccaggaccgtacccacttccacccgaaatggtcttcatgtccaacgccacagtgacactcttagcacccaaacccttatacttattcaccacctgctccacagtgcccttcaattccccaagattgtagaaaacctgcaacccggtcccaacctctgcctggttcaacccttccattccgcgttccagaaccttcatcgcctcgctgcgaagcagatcgcccgtttccctgacccaattgagctcttcgtcgacggcgtcgatgccggcgagatcgtactcgtcgcagaggctgaggatctcgaagtggagctgggcggccttggcgagatcgagtttttcggggtcggcggcggccatgaggtcgcggagcttcttggaaaggcggagggcgcggatggagtgctggaggagctcggtggtgcggtggaggttggagagctgggcggtcttggcggcgacggagcggtgagggtcggagagctcggagcggaggcggcggacggaggactggatcgacgagagcgcggatctgagggtggagagggcgtggtccgcgtggtggagggacgagagctgcgagaggaggtcgtggtgccgcgagaggacttccgagcggagctggttctccaggaggcggatcgcgtggtggagcttctccgcggtggaggccggggagccggaggagagcgcggcggaggagaaggaggtggaggagaaggaaggggagaggaaggcggagaagatgggatccgaggccagagagtctagggcggaggaggagggggtggtggcggtggcggcggcggaggaggggtttttgaaggtggagaggcgttgcatcggagatgcgccggttgagaccggcgtcctcgccgacgctggtgacgccattgtgattttcgttttggcgagcgagcgacgaaggtcgtttagtctggtacagacactaggatggatagttactctattacttttgttttatgtaacttcttgcttctgtaattgttttgtgtgattgtgtctttttttttttatatataatttacttaccattcatgtgattttgattttgttaatgattttttttaaatttagtatcctcactttttaataacatggattttttttaagtgttgaagataagatgtttataattttttgatttttggataaacggataaagtgtgatattttgattagcaagcttttaagtttttttaagtttgctgttataaaaaaaagtgaaagtaagtttaaaatgatttaatgtctgattgaaattggaatacttgaaggtacttttagcatgaacatgcttcctccaaagtaatactcatgtttttgtttgttttgactaataaattgttacttcttatgaaatgacacttcgaaaatcataaaacctaaaaataacgggttcacaaacatgttcttcgtatttttttgactccaatgtacctttagaggtatttgaacgatctttcagacagactaaaatatgtcttactcattgtatacattaaaatgcatatttttgtattgaattttgtaaaaatacttttgtaacattaaaccaaacatagcattaagaaattcagtttgcaaatttttgtaagaatatatataagaatttgatgactttaagtagagaaaaattaaatggctaacaaagatcacatctaaccttgtgtaccaaaacccattgctcctactcatctgtggatcacctaaccttttaacgtgtcaaagatcaaactttttacttgtgagaacttctacaagtgacaagaatgcatctattgatctagaccattctaaacatgcatgaaattgcatcggcttttacggccttccacttttgccaatcctaaacaaattgaagactgaacttatgccaacaagacatgtagacacaccattatctatactttatctaatgaactctttgatgtctactatttctacaaagaactgaaaaagatttgggactccatgaccttgaaattcataactgaacgaacatttcccccctcccccccgtaaaattggtagttccataatgtaatttcactcaaagtggtaatttctgcatttacaataatagaaaccagtcttctctcctcccagtaaataaacaaaaagcagacagatcacctccagcatatttgttcaccaaacagtttctcgcactcttttatacaatatatggaagaaaaaaagtacgaggaagagccaaaattgcaatgctagggaaaattgttctccagaattcatcttttatgctcttcaaattattcattccaacctataaacgtgaaaatatgtcaaactatatatataatatatgatcattcatcatctcatatcttccaatttggtgcagaaaattaagctttcaaattataaaacagagcaagatgggagtgtcaagaaggaattgagtaattgacgctggttaagcaaaaagatgaaatctataatgtaataaagcataaaagatatcattgcaagcttaatttctatgcctattctattactaacgagaaacctggaactgtaaataaatataatttttttattcaggaatcaaagataatataaaaaaatttacaacaattctcacacctgttcaactaactaactgaattagaatctcttgacaaataaatacaattgaagcaaagtagtaatgataaaaaaatgaatgaaatgacaatatttggacaatttttttctataaatattttatttgagaagaaaataaaaaataaaaaaactttttttgtggtgaaattagctaaatcatattttctgacggaacaagccaaagggaggtggcggtggacggtggtgatgattcagaagtggcagccacaacaaaggtagaagaaacagagggtggagacaaggactacagcctcagccgcgtagagtatcttgaaaacgacggtgtccatgatggtcgtttgaagatccagtcgtttccacctaaacggccacgacaccttcttcaaccacagtttgctcttcttgttcttcttcttctcctccatcaaacttagacacactctctattatgtaattttgaacaaagagtatgagctgttgtttgtttatatatagaatattgagatagggttgcatgctttggatgcttcaaagacaaggatgtttgctggcccatgaataggttgaaccgttgaaccgtaaacaaatacttgcactttatttatgaactctacttttctcacatttctccattcctgctccttccgacactttgctctcactcattaaaaaattccaccaatcttgttcccgatttttagtttccgttataaattgtaatagtagataaccagatttaaaatttggtaatggttacaagaattgtaaaaatgtgagataatgataaattgatatagaaaaagtaaaaaatttaaatttaatttttgaatatatataaagtatgatagattagtcatgtagataatataataataaattaatttttaaattttataacttaatcttaaattaatttttaaaaatataatttattgttaaaatgattaatcacattttttcatttgaaaattaaatttgaatttttatcttattaaaataatttcttaccttcttatatttttaggtatcaaaatgattatatcaaaagatatgtgaaatttctacgagatatttatttgcttttcattaaaaatgagttttttttttagagtttaaaccctttaaatgaatcttaaagggatctgtttcttactaagtttggagatacctaaagtttaaaaaaaaatgaaaatattggtaaaaatagtggagttgttgattctggtactgtaaagtttcatttcatgtgttgcatgtaaatttgtattggagagttgttgggggaatgagagcgcgtatgagatttaaaagcttgttaaagatgaagggacatataaaactcttctttttatgaataacaaattctgtaacaatttgatttgatatagaataccatatatcatgtgccagaaatgagaaattcgactggcgtgttcgtctgattggtttgatttttatttaaaaatcatttaaaataaacttaaaaatatatttagttcagtttttatttaaaataaaattcagatcaaattataaactaatattttgacggttgatttggtttgtcttttacaatttttactaaaatattattttattaaaatttatatattttttttcatattttaaataaaattatacattaaaaattattcataataatttacgaaacttattaatatgttaaatcttttataataaaatctgtaaaatttcatttattttaaactaaatatatcttaaaaaagtagtatgaaaaataaaataatatgtattatataaattttatatacataacattacacaacattataaaactcaagtaaaatataagtcttaatataaatattatagtttatatcaatttcaaaaatacaaactggcaaaccaaatcaaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaaaaatcatccaaaaaaatcaattttgttcgatttttgattttttgaacagttttcaatttttattttgagtttttttgaatttgaacactcctaaaaatcaatgttatatgtgaaagaaagaaatgtgatttttatccaatttttaaaaaatgagtatttaaacttatacatattactagaggtaacatatcatatgagttattgtgagtaataatgaaagcattcaattacaattattaggttcaaattatatagattcctcatatacaagctgatacatttttcaagataattaaattaaacatatactacccgttagtaattaaagtcgagatttgagaataaaaactattaatataaaaataaattttaaaatggttaatagtttgagaattttaaaaatgcataaatattaaattatgataattaaagtcatgttttatcctctaaaaaaattataataaaaagatgttcttatatttaatgagagtactgtaaatttatataatataaaggttggtaaatgaattggatcaaagcgcattaagttatgtttgtaatattcctcttaaatgtttttagttgctgaaaaaaatgattttaattttagttcctacgatttttattttattttgatctttcattttatcgatatttatgtttgttgaaggattaatacaattctcatcatttatcaagatttagggtcaattattaaatcatatacaaaatttttctctttattgtttctatattttaaattatattattattattctattaagtgatatgatgtgataattaaaaaaaatgtcatcgtttaataaaatgaaagtagttaatggaaataattaagagtgtacatgtacataaaattgtttaagacccagaaacatatttaaatatttttttacgtattgattatttacgtatgtatgcaaagaaaattgaaatgcaatattcccttacaaacaccaaaagtaatgtgattgtgatctttccagccaatctcacctttgtagaatatataattatatatactttttatgaatttatttatacacaaaatccctcaatccaatattttgtataattgattttgtttgtttataaataaagacaactttgttactaatagaaaacatttttgcagagatgtttattgttttttttggttgcgtggagcaacttgtttcccgcattgttgccgtgcactgcatgatgataacacttcacctggcttggtaacaagggtgtgtatataatataactagcaagtctcaaattaacaaaaattcaacaagaaggggaaaaaaatgaggggagcgtttcattttttatcgattacaattctgatacgttgataaatataatggaggtgagaaaagaatatccggattacattttatgcattaatgatcataagaaatatataattaagaaaactgatctgtatacaggataaggcattctcgtaatttttggtttgttaaaattacatgcattgagtaatttatgaatcttacataacttgtgttcataattaattgatattgatatgcctgtggaggtaaatatgatgacttacttttttgtcatgtacaatagcaacacctatgtaaatcatggatgaatgactacgaactcctgattatcaattgttggtagctgaattagcaaatgtgtgaatgaagatgattgtattgaaagaattatttgttatgtaacttttgatggatttttctatcgataatttttgaagaatttcttcgttagtaatttctgacggatggatccgtaggaaattatcgactgattttttcatcgaaaattaccaacggatatatacataaaaaattattgaaggaacaatctgtcggtaatttcggacataacttaccgacggatatatttgatctgtcgaaaatttttcacggactttaccaacaaatatatccactagaaatttccgatggataaaaaaaatctatcagttaaatttacaataaccattttatcaacgaatttttgtccatcataaaatttgatattaccacggattttagccgtcagaaacattttttttttttgcagtggtatattttaaaacttccgacttttattaaaccattcttaaattaggaatacgtcctaatatgcataccttatttccttgttaaactgttcctactttttactcaattattagaggttgatataatctgatattaatttatgaaagacatgcctagaatatcataatatttaattgttattatgaggtgagtttgaataaaatcaacttataaaaaataaaattgaattaaatgtttttatgaattaaaatcaatataatgatcatttaaatttattatataggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatgtcatcaaacaaaatattttgaaatagttgttattgaagagtttcttaacaaattaataatacaccttaagtgaaatataaaagaaattaatgaaataatccatcaaaattgaatctgagatcttttattcatttcttctataaatttctcaatatatattaaattagctcaggaattggacagatttcaacactttgtgctttattccatctcataatttattttatttgcattgaaaaatggaattatgtactaattggaacatttttcttttgttctccgtgtaaagtacaataatatttctctagttattattaaatgtagtaatagatgacaatagtgttattttcattgaaacaacatcgtgtgaaatacatgttatgtgttggatatcctttctaccgttgtccataactttatctatcaagtccttttttcttgtattttcagcaattttctcattgcagtgttgtcaaaagacaaattgacattatttcattgattccctaatttcactttggtatggtccctccaaaatgggtcaatcaagtggtcccagatactcatgtccacttatgcttagactttagctaatcattgcttacttggtttctccaactacatatgtcaatttccaattgcataatggctagtcatcatcaacactaataacacatttaattcaaattaatcggagttactgtaaatgaacccaaagataaattagaaaaaagaaaaagaaacttcttgaatttaatgactaactaccgtttcataaaccctataaaatataatatatcataaaacccttcaagctttattgtaccaaagccaatggagtgtggtgagaaattctcttattcagcttgtgctaaatatttttgatgaaccgagtagaattaaggagataaatgatactttcatttccttatttccaaaggttgacatggtgcatcggatgaaggatttcagactcattagtttatgcaatgtggtatataagattgtgactaaaatcattgccagtagattgcggaacttgatgtttcgtcttgttttgccatgccaaagtagttttgttcgaaacagacatgcctcaaataatatttttgtggcataggaggtgctccattcgatgagtcacaagaagggtaatgttgggtgggtaaacatcaagattgatcttgagaaagtctataatagacttgattgaagattcgtgaaggagacctgggaagatatccaaattcctgctaatatagtggatattatttgacactgcatatcgtccccaaaaatgaaggtgttgtggaatggagacgttttggaggattttcaaccataaagagaggtattagacaagaggatgctttaccctcatatatttgtcttatgtatcgagcaacttttttcaacttgttaatgttgttgtggaaaatgaattttgggagcccattcaactttctagaggtggccgaaaattgtctcatttgaattttgcagatgatattttatggtttgcaatgactacaaaggagcaggtggagactatcaagacaattctaaatttattctgtgagagctctggtcagaaggtcagcaatgagaagaccagagtatatttttcgaaaaatgttgcatggcaagcaaaggaggagattagccaattattagggtaccaacgtactgaagacttggggtaaatatctaggggttcctatccttcataatagagggaccactaagacataccaattcatcatagagagtcaatcaacatttaagttcctggaagtgagaactttatcttttgcaggaagagtcaccctaactagatctgtgcttcaagcactttcgtcgtatgtgatgcaatatatatgcctggctacctaagtctatttgagatgcagttgataagaaatgtcgtcagcttgtgtggggtgatattaatgaaagtaggagagtgcatatggcttcttggaaggattgtcaataaattcaaaagtccaaatatcaaatctaaattaaactaacatgattaaaatatttttatgactttcgtttttataagatagcaaataaaataatataaagagattttgaattataataagaataattaggattatgactcattagtatcatttttttcctaatcttagtcctaatgaaatttatttcctagttaattatcaattttcaaaatcaactaaagtttatgatcaatgttagctttttgtcttaaatcaatacatcaatgatcatagatctatcaatttaagtcaaaggataaaatcaattctaaggatgatcaatgaaaaataactaatctatcatatattatcaaaatagtttgatcatacaatttggtgcaaaacattctctatataaatctactagttagatgcaaatgatcattactaagtaatcaattgagtattagaatgatcgattctaaataaatattaaaaaaaagaaatttaagtaacataaaataatgagtaatttcattaagaacaatgagagagatatatttggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgtaaaaaaattaaaataaaacttaaagataaaaagagaagcctcattctttatttataatattgtgtggaaattctccttctatcttttcttaattaaaaaatattatcaaatatgatttaaattaattattatggtcatacaaaattatcatgaccgaatagcttcaaaaaattcatgatatttaactttttttttataaaaactcttaaacatctgtctttcacaaacttattctaaactgtgagttttatcaaataaattatatcaaaattcattaatatgacatgaacttacatcaaagtagatttttgaatacactattaataagtggatttttgaatctcagtggagccaagcgaactgtctgcatgaggagattaggcatcatgcagtaagtgattctggttatgcaacttgtggaggtagcaagatatatatatgactatttcataaaggtagcaagatatatatgacatttggcacttttagaattttgttatgacgttttttcataagagtttcttcaacttttacattgattttataaaattatatttatcttctggggattatccataaaaaaattatagaatatttcaaagttttttatgaatacataaatcatataagtagtttcccagaattttctcatagaattaatttgttaaaaatctaaaataatttatattgattcattttatttaattatataaataattaaatcgatattttttaaaattatttattacatatgcattttttaatctcattcaaaaagtaaaaatagaattgtaataaattggaaaaaaatgttttaaaacaatttaagagataaaataataaagtaatgttttaattcttaaagataattaatagtgtatatatatattttttatatatgcgagttattttaattaaataactatatatgtgtaagtatgggacgaggtggatgttgtattcatacccacatttatttttattagattttacgagtaaatctttagtttcagactcatctctaagcgagcaaatcatgtggaaactattattttatttagattgttagttaattaattgaccaaatgaaagcatgtattacgattaatcttgacccttatctaccatagcattgtaaatattagacatctttctgtagtaccgggctaattatttgggtgaaatgtcccagatttttttttttttttcaagcacagaaacctcatgaccaaaagtagtaggattgattcgcatataaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatatttcagtgttttttttttttttccttatcattatagcaatatcatctatattctctgaagtcgaaccagaaccttatttacggttttttttcttcaatatcttcagctttcatatttgatccggagacaatttcaatttatatttagcatattttttacctattttatttcggagagaagtttatattttcccattgtggacgataagcatccaacacagaataaatggttttcgtgagatgggatttgtaacccaacccactaatacacaaagtggtatagaggcccaagtagaatagttcgaagacccatccaatttctcaacagagtgtggaatgtttgggaaaataggtgggttcaccttaatagaggtagaagtatgattccctatgtcagccatcagagtgaactctgaatgtgaagcagtacctgcaaacaacaaaaaaacgaaacatgtctatctggacataccggcagtcagcgagtctatgagtggtgttactagtcaaaaaagcaccagagatgtacacggttcgcaaaaaaaactgtcttccggggacagttggtccaccagacaggcacaattctcgaggagcctctgtcaagttctgaataccatgttaagaaagatagaacaaaggcatttggacttgaacagtgtgtttcaaatacaccacgaatgatactttctatggacttattgtattgaatacacataaatgagaggatattcagtttcttaactttcctctaaatggagataataaaatgaatgcagaatattcgattctcaacactcaacaattcttaggattatcaagtcggttacatgattagatacacgaaaaaaatccaaggagaatgacatccgtgcttcaaaacttgggtgatatgccccaaaacatcaagttgtttaactaagatataactcttgacatatatgcccagcatagaggcaagccattaaacatgagccgctagttatggttgttagtatcgcacgatacacgattcgaatcgcacgatttgatccgatacatgctgaaaacgatacgaaccggaccactgaatcattttgaagttgaatcgcaacattgaatcgtgaaatcgtatgattcaaaactgaatcgtgaatcgctctcaagtttccgattcaaattttacgtgagaagataaaaccgagaagaaagaaaaaacgattcaacttgaaaaaagagtcacggaattggaagataaaaccgaaaagaaaagaaagaaaaaaagaaacagagaagttgcagaaaagaagccaagacgcagtgacgcacatagaaagaagttgcagagaagaaacgcaacgcacagagagttgaagacgaagtctctccgtcgtcggcgtcacagcttggggccatcttcgtcgctggcgtcatcaaagcttgaggtcctcgctcatggtggtttgtggagacaaagtcacaaacaaagcactggaggcgtgaaggtgaggctgcggaagagaagaccgtggcttttatttgggaacagaagacaaagtgttatggggattaggattttttatttggaccccagatccgatttacttcttgcactcccgtttttgcttactttactccttttggctattttttttcttaaaaatttcacttgatattgtaattctagatactgatagtgatagttatgataatattagtcttgaaatttaattactatgagaataaatggttttatatttggttacttatatattttagtacttaaatttttttttaatttggatttatataatattatatatttttaagttatttttaatttgtttctgaatcttacgattcgatacgattcatgatacaaaaaaacagctgaacgattcacgatacgtattgcgattcaacaaccttgtttgaacccaacccatagactctaatgtaccttcacgaccctttgaacacgtcactccactctctctattggagaaggtttgccctgaaccttaagatcatcagaaacaagtcgaacctggaattcaaacccatgttggctaactatgataccaaatggtataactaagaaagtccagtatactaagtttaagctattagtaacagcgtaactcttgacatataacatcctatataagatgcagactgttgcatatttaagtcaatttaatcatgggccaccatgctaacccaacatgcatcctctaggcaaatcattaggtttgttcaaaatttaactatttagcaaagggataacatacagcggttacagccacgtaggcctagtgctttgtattaagtggaaaaaatcagctagctgcagcagacaaaccaaaggaaaatcccctaatatcaaataaagctagatcactttatataacatccattgagtatacattgagtgagaaaccatccaataattctgagatgttcacctcaacaaattaacttcataaataaagcagatcaaccacaagaaagaatttgcagcatcaaaatagagcgaaagcaaacaccatatccatattgggtcaagcatccaattgatagagaacacgtgaattcaaatataggatatagaacagtccaaagaacatttcataaaattgcaaatgcagaactgattacctgctaatattcatattataaattactattaaagcaaaatgtatgaaatacataagaaaattaaaaaaaataataaaaacttccgaagaaactggatgtctacacagttctacttttggccatcagtgtatcatcaaagaggaaaatcaaactctaaaccaaaataatgcagcaaattatctactttgaaatactttaactgttcagacatcacacccaccctcaattcttactgcactgtgcatatcattaatattgcaccaatcgcataaaacagacattaaatccaaggatgaacaattcatccaggtcagaatccagtgattaaaaagatattcatacttctcgtaataaaaacaatgatccagaagcagattcccattctttgtaggtgctggtgataatcaagaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaagagagtataggatgcaaacacacaccaataagaaatagaagtaactatcttttctttatcaacatccttttatccaatttgcatcagaaatgaaaatactcatccttaccattcagttcatccaaagcaaggcaataacagttcattaataggtaacttggtactgtaaatattcgtcctcatttactatcatccctagtaattaatgagaagtagcagcatgcattgcccaagtcgagacacgccgctacaatggtggcataaaagatcacaaagccgcagctatgttggtactgtggtgcaacacaaatggagctccagcagaagctggatgccactccacacatcacacacacacacacacacacacacacacacacacacacacacacacacacactaatctatagtgcttacaattaactactttgctcacaccaccaagtcatggtgaaatgtaatcaaccatcataacaacagttaaaataattcccagcgacaaaacaataaagacactgaaacacaacaatcaatcttgttattgttcaaggagtgtcaatattaaacaagacagcaaagcaaaaaatcatgtctaacgataaatctacaacaagtttgcacaacagaattcaatcaaagcttactattttttcaaactaaaagccatatcaattctttctatcatgagcaaccaaaccaaccattaaattaggtggctttggcaggatgattccccttggcctccccggaacaacagtcaccgtcatgctggtggtgatggtgatgatggtggtgctgcttccccttgagctgcttcctcatgtcataagcatcctccccgtcggcataatacttggcctccacatcatgaatcttgtatcccagggtcaccgtgtacaaattgaaggccgcacggttgctcttgcgcacgtgcagggacacgtactcggcaccaaacacctgaagcgatcaatcaaaattgaaattgaggggctaaaaacataatcggacgcggcgactaatttgtaatttgtaaatggaaagaaataatgggatgcctgttccatggcgttctgggcggcggtcatgagcttggtggcgaggccgagcttgcggtgagtgcggaggacggcgagggaggtgatgtgaccgtggcagtcggtggtctcttcctccatcttggcgaggacgtagccgacgatgcgggcgttgtagtcttcggctacgtagaggaggtggggccaggagaggatgtgatagaggtagtacttcatctggtagttctccggcaggcagaacaggttgcacgcctgcatcgccagtaggtcattcaccgtcgccttccttatgcacaccattttttcccctttcctttcttctctctcacgattagggcaaacacacaacgcaacacctaggagcagtgttttaagagctggggagccgattatcgaactgctagacttattaggttaatgggtcacgggtggaattggagttctactgggttaatggatcttgggtcaaattagagtctcacttctcgaatcaaattaggagttaggaccaacaagcaccacaacacttaggagtagtgttttaagaatcatatacaacatcgaatcggttgagataatgacttaatgagttattgatggaaatcgaagtctcattggattaatgaattattggtcgaatcgaattaggaccaagacacaatgcaatgcctaagagcagtgttttaagaactagacccatcatccaataagtgagacattggattaacgagtcattggtggaatcaatctcactaatcaaatcaatttgacttagtatatattaaaacaatataaatataaataactaacataatttgattaattaatatgctaaatttaaaatgatcatcattataagttatttaatatctcaaataataaccaatattcatgtcaatagaaattcaataataagtttcaaatacaaacaaatatccaatgtcttaaaaatatacttttttatatacataataatttattttttaatatagatccttagttattaattaaaataaaatattatgtattattttaaatttaactacatatttataaaactagtactttcaattattactttttataaaatatattttatagtactgaagattcaagtgaagattaattatagatttgtttttcctatttaattttactaattttactctataaatttcctttaattcctttgtaatgctataaaaacttgttttctgtttctgtactgctcctctgtattgtgtcacttcttggtgttgcatcgttatgaggtctcacacaaaaccctatgagagtctaccatcctagctttgttggtgttaatatattttttcttagttattcaattgatgttttattagtacgtaaaaatctcacctttaatggaccaagtttttttcttcaaaatacataaaattcttaaccaaattaaaagaaatatagtttaatcatataaaaataaaaaagtagtgtgtgaacaaaatttaaaccagataaagtctaaaaatagaaagagttgaagattgaacataaatagaaaagttataaaatcaaatagctagtttatcacatgtataaagagagagagagcaacacacttctatgaattcggaagtgagactactgaaaatagcattgtaagatagacttggtctggcaccataaatcattcttcttctccgtcaacattctatactctgacaaatctctcattgtcaatcaaacttcttctctctaactacttttgttctcttaccatgaataatttgaactttcattcttatctttcagtgtagctataacatgttcaacatccaatagatcttgccacggtaaattaatgttggtgtatataatttcatttacatttcttgttccattaatttctcttcaggaatcatcaccaagctatttatcaatcaaaatggaaaataggctagcactggaatacaatatacatgtagattttgttaattaattactagaaaaagtagtaaattatataggtgtaggtgttaggtgtagcaattagaaacaatgtcatccattaataggcaaccttcgaagaaatctgcacgtagttctggaggatcaacatctcaagggtcacaaaactctagcgggccaagtgttaagtttgcgagaagaacttcaagtggaaggtatgtgagtctgtcaagggatgacattgatgcgtcctcagacttatcaggggattacatgaactacactgttcatatacctcctaccccagacaatcaacccatggactcatctgttgcaatgaaagctgaagaacaatatgtttctaattctttgtttaccgggggattcaacagtgtcactcgagcgcatctaatggataaggtcattgattctgaagtcactcatcctcaaatggcaggctccaaaggctctgtatgttcaatttgtgatggcagggtcatgagggatgagaggggacatgatgtcactccctgtgagtgcaggtacgtgttattattaggtcctcataatcctaaggatattattatttaaggaattaaaaagataaaataataattgtaaaaataatatgaaagtgtaaaaaaattatataaaaaaacataattttctgtctctgaataagaatttttctctttttaacttcttaactaatgtctgaaggatacttgttagcatttgtcgtcttatcatcatttcttaattttgacattatttttatttgatttcttgttgagaattgaagagaaactaactaagttacataataataattcaaatttaggtacaagatttgtagagattgctttatagatgcacaaaaagaatctggtatatgtcccggttgcaaggagccatataaagtcggggaatatgaggaagacctcacagatcagtattctaacaatggggcattgccattaccagcgccagatggttccaaacgtaacgcaaacaacatgtcagttatgaagagaaatcaaaatggagaatttgaccataacaagtggttgtttgagactcaaggtacctacggagttggtaatgcatattggccccaagatgacatgtatggtgatgatagtgatgatgccctaaaggcaggaatgctggatcaagagaagccatggaagcctttgagccgggtaataccaattccatcaggcatcataagtccttacaggttaattaattatatcaatttatgctgcccatagtttgtaattataacgatgataataataaggtttaatacatttttcctttatctaatttaacattttgttcattgttatttttgtattttttctattttagtctttctaaaatgtgtttgttttattttttatctgtaaaatattttagatgacaatttttttattgtataattcaaaaaatattttggtactgtttaaaatactgtatatttctttaaagatgaaaaatacatattattttacgactaaaatggaaaaaattacaaaaaaaaaatactaaattgcataaaaaatgtatttaagtctaataataataattacatgaccaaatctatgtctatgtatctatttgcaggttacttatcttggtgcgacttatagtattgtgcttttttttacactggagagtggtaaatccaaataaagatgcagtatggttgtggcttatgtcaattacttgtgagatatggtttggcttctcatggattctagatcaaattccgaagctttgccctgtgaatcgttccactgaccttgaagtccttcatgaaaaatttgatagtccatccccatcaaatcccactgggcgatctgatctacccggtatggacatttttgtgtccactgctgatcctgagaaggagccacctctaaccactgccaataccattctttccatattagcagttgattaccctgttgaaaagcttgcatgctacgtttctgatgatggaggtgctctcttgacttttgaagccatggccgaggctgcaagttttgctgatttatgggttcccttttgccgaaaacacaacattgagccgaggaatccagacacatattttagcttgaaagttgatcctaccaagaacaaaagcaggacggattttgtcaaggacagaaggagagttaagagggagtatgatgagttcaaggtacgtataaatggccttccagattccatcaggagaagatctgatgcatttaatgctagagaggagatgaagatgatgaagcatatgaaagagagtggagctgacccttctgagtctgtcaaagtattaaaggccacatggatggctgatggcactcactggcctggtacatgggccaatccttctggtgaacatgctaaaggtgaccatgctggaatacttcaggtgccacacctacctagaaatttttatttttttaattttgataagagtttagctttgttgaattcagaaactcacatagaatcagagtagaccttacatattatttaccaacaaggtttatggacactgaaaatcgaactgatgtcttttttataaaatgagtatgttagttatcaactggaaccaacctttgttggcacctagctagcagtttctatttttatttttgaaaaaagtttagcagagttggatcacatagtattagagctaactcttaatatattatgcaccatgaaggttctcacattagtaacgaaaatcaaattcatgttcttcgtgaaacatgaatatgttacttaattggatcaaccatgtcaactagctagcaatttgagtaaccaataaaataaaagagatatgacgtgcatattcaaaatcaatttaacttaaatatcgtatataataatcgtattttaatccaacttttttgcgttaatgaatgtaggtgatgctaaagccaccaagtcccgatccgttaattggaagtgcagatgaaaagattctagacttcacagaggtagatacacggttgccaatgtttgtatatgtttctcgggagaaacgaccaggttacgatcacaacaagaaagctggtgcgatgaatgcattagttcgagcatctgcagttttgtcgaacgggccattcattctcaaccttgactgtgaccattatgtctataactgcaaggcagtaagagaagggatgtgcttcatgatggacagaggtggcgaggacatatgctacatccagttcccacaaagattcgaaggcattgacccttcagatcgttatgccaaccacaacactgtgttctttgatggaaacatgcgagcccttgatggtcttcaaggtccaatgtacgtgggaactggatgcatgtttcgacgatttgctctatacggattcgaccctcccttcgtggacaaggacgccgacaagaaagatggtaaaaagattcaagggtccgaaacgccgtccatgaatgccagcgagtttgatccaaaccttgatgtgaacttactccccaagcgctttggaaattcaaccatgctggctgagagcatacccatcgcagagttccaaggacgtcctttagcagatcacccagccatcaagtttggacgtccaatcggtgttcttaggacccctcgcgagccactcgatgctactaccgtagccgaagccgtatctgtcatttcttgttggttcgtctttctctatattaattagaataattatcttgaacaagagttttctctttaacaaaagcattttattttctcaaagagttcttaaagatttttcttaatttcttgtctatgtataataggtacgaagacaagactgaatggggagacagagtgggatggatttacgggtctgtgacagaagatgtggttacaggataccgcatgcataaccgcggatggcgttcggtgtattgcataacgaagcgagatgcatttcgtggatcggcaccaattaatctcaccgatcgattgcaccaggtgctgagatgggccacaggctcagttgaaatattcttctctaagaacaacgcattcctcgccagcaagcgcctccagcttctccagcgtctctcttacctcaacgttggcatctaccccttcacctccatcttccttgtcgtgtattgcttcctccccgcgctctctttgttctctggttccttcattgtcgaaaccctcagcattgccttcttaatctacttgctcatcatcaccgtatgcctggtgatgctggccattctggaggtgaagtggtctggtgtggagttagagcaatggtggagaaacgaacagttttggctcatttctggaaccagtgctcacttggctgctgtggtgcaaggactcctcaaggtgatggcagggattgagatctctttcacgctgacgtccaaatcggccggggaagatgaggatgacatgtttgcagatttgtatctagtcaagtggagctcactcatggttccgccaattgttattgctatgaccaacatcattgccattgcggttgcgttttccaggactatttacagtgccaatgcacaatggagcaagtttattggaggtgcattcttcagtttctgggtgcttgctcatttgtacccttttgcaaaagggttgatggggaggagaggcaagacacccactattgtgtttgtgtggtcaggtctcattgcaatcacactttctttgctttgggtttccattagcccaccccaaggtgctgaaggacaaggtgtagggggagattttcaatttccatgaaataacaatattattattgctaatgcaaggccaggtgggtgggtgtgactcatatgtttttagtttttctttttgtcttattattatatgtacgtaacagtcatgtatttttgtaaaccttcaattcacatgtcttaagtacataaataggacaagaaaaattagtcttagatcgaggtttttttcttttgaaaaaaaggtcaaagcaataataatactattattaattagtttatacatgacgacatgattgatgttcataatgtgcatctgggttagttactgtcattgagcattccattttttccatcttcaaaagcattacatgtttatgttgtttgatttattcagtagagtagatgaattgttaaacatcttagtaacttaaattaaagtgaactaaaggaaaaatgaagttcaaatgaatctgaaaacggactaattaaccttcaattgtttcactggtcaaattggtgccagaagaaaagggtttggcaagccttttacaggtacaattcataattcctcaaaatttaattgagcttaagtacttaaaaaaaatggtaatcaatttggcaaaatattataattaattgttcttactgtaatcttacaaattacgtgctgcttaagcaactaaacatcagtaaagtaatcaatttgtttgggtatttgttgtagctctaattgctaactttacttacagaaatgggctgccctaataagtggctcactgttatgggctatatttttgtttctgggtacatatgggctgtctaatttttgtatttacaggatgtaccaatcctatgaccagaaaagagaaagaaggaaaagaaaatagtggaaataaaaaatatcaattattttaatgtatggaaatttttacaaaaaataaaatgaattatgtagtatatgatacgcagagcattgagcatgcgctatgaaattttcaactagtatggatattttaacgatttacaaaagtctcaagatggtttaaattttcaatctttttgcccataaaaatctcaattaattaactagattgagccatctcttagaaccctttcagttggcttttcgtcttttttaaaattttacgaatacaaaatttatcacataattctcattgttacgtgtaggagaatgttaattaaaacactagtaaaaaaagtaaaagtgaaaaattgttattaaaagtaataaattgaagattattaacatatttatgcattaagttttaataatgcttttattttttttaaattttttaattaatatctttaaactactcgtgaacggttcctaaattttatcaaagataacaaagaagaagcaagacaacaagcaaggtgtttcttttttttatatatcaattggaatcgattcagtgaatcagtctaaaacaaaaggataagtgtgacgaagtaccacaaacactagtttgtctgcttttgccaactctcacccaagtagctaccttctttgtctgattgataaaggagagggacgtgccaatgaaatcaatcgtatcgaactaaaatttggtgcaatcaattcaatgcattactagctatttcggaaacgcatattttgtaaaagagctcgaaaacaatgaagggaaatatgttaagagaagagataaagtttggttgatggtggttaccactttgagggatgatggctcacttgccacaaactttcgcatcaaacacatgggcgacaccttgatttttaaccattttgttcaaacatcataggctttggtgagtgccagataacggaggcaagtttttaaatatataaaacagttcaaaagtatgaattttatgttataatgcgtcatctcatttatttaatgagtttttttggtaatttatttatttatttaataagtttgaaaatacataagatgtcaatttaatttattaaagtctaaatcatattttttatccgtaaaaatcataaaaattaattatcaaaagatttacaataattcacacatcaaatttaacaaactaaggtaattaaactccattgacaaagcataaaacatatattagatgattgtgcataactttatttattattaatgaattttattttattttatttctaaaactaaatattttgtcagatatctatccctgaagttgatatgagctagggggaaataggcatagtgctttaattgccgtttgtcaaatgaaaagtatagagtcaaaatctggatataaccaagttgactttatcttgcaggaagcaagtggagttgtataagttgcatatcagcaatagcatggagaaatgaaaaagatagatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttctttttttttctttatattttcttaatttgttattcatatgcatttttttttatcattattgtattatttcttgcacaacttatgaggaaagtattgtgtagccaagtttaaataaatatgttataactcaagttatggtaatacgtatgttttaatttatatagaattgttagaatataaaatattcaagtattgatacaaagtcactcgtataataacatattgatagttcatacgagtatgacatcgataagtaatcaattttgaaatatggattactactagaaaataagcttttaaattggttgtttttgactttcaacatagatgttaacatcagttttcaaaaagtgatgttaagatacactatgcaacattaatttttaagaaaatcgatgttgtataataagaaataaataaaaaaatgtaaaatatacaaaaatcaatttcggtatttaaaaaaacaatgttatgatacacttgacaatatcgattttcttaaaaatcgatattgtgttgcacacgacaacattgattttcaggaaaattgatgttgttaagtttaccacaacattggttctctaaataatcgatgtggaaaaccactttctatatcagttctgccaaaaccaatgttgaatagtacttacaacatcaattttgttgaatagtacttataaaaacgatgtggaaaatgattggtcttgtcggtctttgcgaacttggagaagagaaagagtgaacaaagaaataggggagcacaaagtagcaaagagtgagcgcgatgttattataaaaacatccagtcgcttgagttttaatttagtaaaaatccaacatcggttgttaaaaaaccaatgttaacaaaaatcaattaacattgattttttataaaactggtgttaacattgctatgttaatatcaattttttaataactgatgttaatattgtcacgttaacatcgatttttgaaaaatctacgttaatattactacattaacatcgatttttgaaaaatcgatattaagagcgtcacgttaacatcgatttttttaaaaaccaatgttaacaaaaccaatttatttataaaaaaaatgtcaccgcccttttgttaacatcgattttatcaaaaaaattgatattaaagtaagaatattgaaagcattctttctagtgcatgcatcagattcaatctacaaagtggacattcatacatattactaacttacttaagacaaatattacaattttgaaaatttagaaaatagtttaatcttaaaataaaatttaaaaaattgcaaactacaattaacgaagcaaaaaattcaaaggaagaggcaggtttatacatggagtaatgtgatttacacatcaatttttttacaataaatacacaagataaagagagatgagaagtgaaaaacaaagtgtgtatatatatatgttagatatataatatgaccttgagaaataacaaaaaaaataacacttccttattatttaagatttaagagagagaaagagatacaagaaataaaattattataagaataataagtaataaatcctccgcaaaacaaaacaacaaaaagtagtattaatatcctagtaagcaataacacactctttatcaaaacatactaatcttgtgattggtgttctttaatgaatgaataagacacacgtaaaattcagtttattaattaatattaatgagtgcatatcatgaaccacacaagacaaggcaagacacacaaataagaacaaacgaatgaagaatatgcggggctcaccattccgtacctatcatgtggtcaggttctcttcatctccatttccatttccatttccttctccttctttctttcctcttcaacatgtcttaataaaattcccactcatactcttctttccaacacaaccaaataatctcttgcaccttaattctatcgcatactctgcctcttcattgcataggcacgtgaacggccatgtcaatgaattcccacgtaaaattcatgaaattccccacgttctgactaaggttttgaagtgtgtttgaagacaacactgcactgcactagtgttacacacatatatagacaacaacacaaaagaaactttgtgtgtgtgtgtgtgtgtatatatatatatatattctaatggctggcaatgaatggattaatgggtaccttgaggctatactatccactggaactggggctggcaccgttgatgagcaaatgcaaaaagcagtggctccaccagaaagtgcacattttaatcccacaaagtactttgtggaagaagtggtgtccagtgttgacgagtctgaccttcaccgtacatggatcaaggtggttgccactcgtaacaccagggaacgcagctcaaggttggagaacatgtgctggcgaatttggcatcttgcccgcaagaagaaacaggtaacaatcacatttcatttagtgctaattgcctaaggttcgaaccctgcagggagagttgtttacatttagtgtctgacaatacttcaaacaacaaacaagattggttctgaagaagaatacttgttaggaatgaagaaaaaaataacactaaacatgacaataacacttgatttgaaagtagaattgatagtaatatatatgtacatgtgcacctaagttttttaatgtttctttgtttgattttgttgaatgctatgcaatagaatctcgagtggccaagcaaaatgttgtttggtttaaattgtaaattttcatttttgttgtatttgctttttcattcgatgaatttgggggaagtatatatacatatatatatatatatatatatatatatatatatataccagagtgattgtgagtgaaattaatggggcactacttgtagttggaaggggaggagctgcagagattagcaaacagaagatgggagagagaacaaggacgcagggatgcaacagaggacctgtctgaagagttgtcagaaggggaaaaaggagatggcgttggggagatgatacaaattgagacatcaaagaaaaatttccagaggcagatttccaacttggaagtatggtctgatgacaaaaaggaaaagaaactttacattgtcctcttaaggtatattaattcttcacttcctcacaatcattttgcattcaataaatatgtttagccaaatttcttgattgtgttttactaaggtatattgattgtttgactatgacccttgtcatttgacagtttgcatggtttggtgcgaggagaaaacatggagcttggtcgagattctgatactggtggacaggtattacacattgctacatgaataagctgtgacccttccatttagtgtgtgttttgatgccagttggtgagagaaattattagatggtctgagatgatcatggtcctattaatctttacgtatatgacaagtaatgaactgttattaattctttttcataaatgaaaaaattcgagtacatgtcacatagattagtcaaaactatggataggtgatagttctaaattatctaataatttgtcggttgaagtagcttaaaaatacttatactctcaaaacaatcaatcttccttctcattttttgtcttggaattcaagaatatgaattggaattcccaaaaacatattcccaacttttatcaaacatagccttaattggtgttcaacaatgattcaatttcaaccaatgtattttttccagattaaatatgtggtagaacttgctcgtgcactagcaaaaatgccaggagtgtatagagtagacctcttcacacgccaaatctcatctcctgaaattgattggagctacggagaacctacagaaatgctaagtgcaggcacagatgaggatgatgataacattggggagagcagtggtgcatatatcataagaataccctttggtccacgtgaaaaatatctacagaaagaacttctttggccctatattcaggaatttgtagatggggctttagctcacattctcaatatgtcaaaagtattgggtgaacaagttagtggggggcaacctgtgtggccatacgttattcatggacattatgccgatgctggagatagtgctgctcttctttcaggtgccttgaatgtgccaatggtgctcactggccattcactaggaagaaacaagctagaacagcttcttaagcaagggcgtcaatcgaaggaggatatcaactcaacatataagataatgaggagaatagaagcagaagagctttccctagatgctgctgaacttgttatcactagcacaaggcaagaaattgatgagcaatggggactttatgatgggtttgatgtcaagcttgagaaagttttgcgagctcgagttagacgtggtgtcaattgtcatggccgattcatgccaaggatggcggtaagaatgcaactagggtcacacacacactcaatgtttgaaagtcttttatttcttaaaccttggtgatacttctttggaaaaggaaacaactatgtaccaactttttcaagggatggttatatcagttactttatttggtgttttcttatgcaccttagcatgtcttaaattctcaaatttaagataacgtgttgtatgaagtactaatggttcaaacttatgtaggttatcccgcctggtatggactttagcaatgttgtgacacaagaagatggccctgaagttgatggggagctcacacagcttactcgtggtgttgatgagtcttcaccaaaggctttacctacaatctggttagaagtgagtaactaacatgtctacatatcttggattacattgagttcttcataaatacttataggagaagaaaataagaaggtaaaatgaattaaacttctcctataagttaaaatcacttatgtattttaacttttttattgaagttttcttatgaaagaaatttgattcattttgcttattgttttcttccttagttcctttataattatccagagtcaatgactagccttgtcaagttgtaactgataactttgtgcaggtgatgcgtttcttcacaaatcctcataaacctatgatcttagccttgtcaaggccagatccgaaaaagaacataaccactttgttaaaagcctttggagaatgccgtcccttaagagaattagctaatcttgtaagttgacataattcaactgctcaatacttggtggaaacaatggttgagaacttgtaaaaaggactaatatgttttcaaacagacgcttataatgggaaacagggatgacatagatgaaatgtcctctggcaatgctagtgtgctcacaacagtgttgaaattgattgataagtatgacctgtacgggcaagtggcatacccaaaacatcacaaccaatctgatgttccagagatatacagatttgctgcaaaaacaaaggtataaaatttattgaagttttagtatatgttgagatctaacttcttatgtgataacaatgatggccagctaactagtttgaaatttctctcagggtgttttcataaatccggctttagtggaaccctttggccttactttaattgaggcaggtttttaactaactagccacttttgtaatattattcttattttgatgttgaagtgattattgaatgtgcttaaactcatgcaggcagctgcccatggacttccaatggtggccactaaaaatgggggacctgtggacattcatcgggtaatttaagaattaagtttagatagtcagttgcatgatccatgctaggaagttcatgaattatttgtcaaatggcatcaaagcattggaaaaaaatttgtaaaccaagattttaattcccactaggagagttactcacatttagtatctgacacggcctcaaatatgattgtctccgaaggaggaaaccaaaaaaaaatgcagtatgtagtgatttggatattaattgtacatcccatatttgctttttcttgttttatttattttggaaatcaaacaggatgaacacctaattaggtctagctccttttgaattgtgatgttaggccctgaacaatggtttgcttgtggatcctcatgatgacatagcaattgctgatgcattggtgaagttgttgtcagagaaaaacatgtggcatgagtgcaggaagaacggttggaagaacatacaccttttctcatggcctgaacactgtcgcacttacttgacccgggcggctgcctgtcggatgaggcatccacaatggcaaaccaacaatccagaggatgataaagctgttgaagaagaagagtctttcaacgattcgctcaaggacgaacacgacatgtcccttaggctctcaattgatggtgacttgactgcagcaagtggaggcactggtctagatatgcaagaccaagttaaacgcatcctaagcaagataaggaagacagattctggctcaaatggtaatggtggtggaaatgtcaatatgctgcttgacaatgtaactagcactagcactaacactagcaaatatcctctattgaggagaaggcgtaggttgattgttatagcacttgatttgtatgacaataatggagctccagagaagaacatgattgagatagtgcaaaagataattaaagctgtgcaattagaccctcaaactgctagagttacagggattgctttatcaactgctatgccagtgatagaagcagtagagttccttacatcaggcaatgttcaagtgaatgagtttgatgctttaatttgcagtagtggaagtcaagtttactaccctggcatcaatacagaagaaggaaagcttttgcctgatccagattatgaggtacatattgactatcgttgggggtgtgaaggtcttaagaaaaccatttggaaacttatgaatggtgatgagaacagccccattgaggaagatctgaaatccagcaatgcacattgcatctcatacaaaataaaggatcttagtaaggtataaatcaacatgacatttaccattatattaagttacataatggctagctggaggcactaagagataaatgataatcatgtgtattaaattcaggcaaaaaaagttgatgagttgaggcagaagcttaggatgcgaggtctacgttgtcatcctatgtactgcagggggtcatcaagaatgcatttaattcctcttcttgcatctagagcccaggcactcaggtaattaacacttcatccttaatttctaactaattttttcaatcaattcataatataaaacaagtaatattgagtacatgattgatttcacgttgagtcatccaaaatcacattaaaatagtatcaattaacatgcattttaagtaaatgctcatgtgttcaatttcacgttgaagaatttatagcatgttatgatctagttggtttaaaagttgcatcaatttcaaacacacttaacataaaaagctaaaatagataggttccaaatatcatgggcatgttctttgtgcgagttttctctcgaggaatgtcaaatcaaacgcaaaatgattctacggctagaaccgattttagttaaaagtaatcttatttcgaaattttatacaaaattttattgctttgttttaagaataaaaacacccaaacttaaatatacgacttcaaaatcaattatatttagaatcaatttaatttgaaatcaatttttcaaacgttagcctaatcacaaactgaatgtttattatttgcttaaatatgttaattaggtatctctttgtacgttggagattgaacgttgcaaacatgtacgtcatccttggagaaaccggggacacggattatgaggagatgatttctggaactcacaagaccataatcatgaagggagtgatttctaagggttcagaagagttactaagaggtccaggaagctaccaaagagatgatattgtcccaaatgagagccctcttgttgcatccattactgaaacaacacatgaaaacattgctaatgctttgaagcaactttccaaatctggaggaatctgaagtgctacgtactatatattaagtgcattttctttgctctctcttctcaaaacaagtaataaatttatgagagtggtatatgaatatcttcacatatgtggccactttaatatattacacacttcatcaatatctattatttttctgtattttttttttattcttatcgtatcatttcacttattatatatactcatatttatatttatttttttctctttttctctctaggtgttaaccagaagattggtccaccaatcttttcctaaatttatttaccaccacagtcaaaaagaaaaaatgaattgatgtaaatgatctgttacctaatgcatatattaaatgtggctaaagtgtagctagatcatgcttttctttgttacaaattgtttttcttgatagagcttcaagaagttatatataatttctctaaaatacgaataaattgaactcgaaatttttgtgcaatcacccgagaattgagatagataaattttactaaaatagtttcattagcacccaaagtattataagacaaaacccgccaattgtagcagcatccgttaaaatttgtccctttttatatatttacctcggtgttatgtgtgtttgagaaaacagtgaaatttatgtaatgagactttcctacttaatgaactgaatttttggtgattagagttcactccgtaagcctaatgtaataatgtgaagtatatatatatttttacatttggagatcaaatagaaacttgatgtaaatttgagagatattaaaatacttaattttaaaaaaatattatttaattaatttaatgtgtatattgttgacgtggatgtcattaagtagctacatcaacaatgcgtttaatatatgctattatctaagagggatgaaaaaatattttgcaaaattggagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaattcacaaatgttgctttcaaaaaaataatagtattgttagaattcaaattataacaatatattgatatattacatgtttggcccacaattaaactaattgaataatatatcttttcaattcacattgttaattataaaacctcatcattcccgctatcacagggggaaataattacttttatctttgtgaaattataatatttgattaaattgctactttatacatttggatattttatatttgttgactatatatttttatattaataaaaaaatgttgttccctatgaatttagacttgatgaagttattattgaaatactaaatccgtatatgcaagagttgagtacaccggaaaaaaaaatgcaagagttgaaccatatatataaaataatatctttcaaatgtggataaaaaagaataccttgacaatagtttgagccaatagtaattttaagctcatataataatagataataataaatagtgattctaatagtaattattttaaaaaaagtgaggaaaagtgcaaaggttttgtccggattatctttaataaaaaattatgcttcgaatcaaagtatctatttcttcctccattggtggctttttgtggccctctaaacccatactcagaaaatgcacagtttttaactcaagctttcgattttctctcaggaaaggtctgaagatcaagcttagtcaaaacgtattgacaaaattacctctctcactatagtcacccgaattttatatcatgcggggcatagttaaacatcaaggcatgccattatctattaagggcaaaaaaacataccattcagcaagttatattcgcctaatatatgtattttcaataagttggcaactaaaagcttctgactttcacacatttaatctaatctgaaagggaaatttagccattactggtagagaattaatttcttataataataataataataaattatatatgctattggttggtttacaactttacataaaaaaagttttttttttttcttaaataaagtggatgatctttattttcttaaccatacttgactaaatttgagttgattaagaaataatgcaattttattacttcacttttttccctccaccatgtttttgtgtttatatttgctggttttttccgcataattttaaaaaatgttatttcttactagatattcaaatgttgtaatttttccctctctctcaataatatgaaataattagtctaggattgaacatatcaagctctactaggaacaatatttttttttatatgtgttacatatagaataattcattcaataatttatacagtattaaaaatacaattttctttgaataatgatattttatttaatttaaaaattaatttctaagattctttttattattattttgattttaagattttctttccatcttggttttctatgatccgttcaaaacatagagttaattttgggatgttcaaaaaccaaaacccgaagcaaattgaaatggcatgtgaggggaagcatagtagcatggtgccaagtttcaagatttgcataagatttttccctttcacacaaataggatagtttggtgaacagacatgacatcagaggaagcctagatttggtgctcagctcgtctgttggattgaggttgactctctctcccctctctctcttcactttacctttcttccttactcattacaattttccattttttctttctttctttctttctaccagccatccataaacaccgtacatacctattcatttcacatttgctttccctttactgtttctctctctctctctctcgctctctctgtctctgctttccttcattgcaaaccaagcttcctttccagcttggtctggtcctgccctcagacacaacacaatacccaccaaccatttttaccacatttactctttctcttctctaattagtaaaatacaaccattctctctctgcctctttattttcccatcaaaataagatttttgtctggcattcccttccattttcttatattaatattttttacattttatttttttgtttaagtgtggcccacttgttacctactgttgtgccactacatcttttgcagcatctggattttgctgtagggtatgtgtgttgctcatcctcaggtattctttgcacattaagtctcttgtcggttcaaaatgaggtgtgaaacctgttgcttctttgggtagaggattcaggagtctagctaccttggatcaccacaaaggtaaatgctttgtctttctcaatcactttttggataatatacattttactttctcttttgtttgcttggatcataagtgatgctttcctggtttcctttctttttttcattagaaattgttgtgcttatcaacatgcatcaggttattttactttcccaaatgaactgtgaattcattcatcatgcctttttgattgtgttggttttgaaactgctgaattatatatgctacttcttgtattaattggattatgttttattgtatgccattgccaataaagcctgagatgggagtctttcatcttcaaatttagcttacaggaaattttgtagtctgagattaccttaaattatgattaagatgcaattagtgatttgttaaactcttgctttggttgttgtttatggcattgttgcaagaactgaaatgttggctgtaaattagtatgttcagatgtgtgtttcgaagtcttgagtaaggggagtacttaacttgaatcctgtacttgagtgggaatgtcttggttctaccagctgaagaacttgtggggacgatattgattgactcggtgcaaccaattatgtcatccaacagttctttgaatatggaattgtcaaagaagacgtcatttttgggtttgaaacgatgggttttgattgggataggtgtcggtgcatttatagtgctgattttgtgtatattatcgatatgggcaatgtttcggagaaagtctaggagatctctggacaagtattctgtatcccaaataccaaatttctcaaaagatatcgatgttgacaaggttggggtgcagagttctcatgttcaaccagaaaatgtggttattcctgttcatgacaaggcaagtgacaacaattcagataatgtatcagtttgtttgggaaatagcaaatctggtgatcctgataatatcagtcagtgcagctcaatttatcatcatgagagaggattgagttcaatgtcagccgaagaaggaagctctgggaatgttaagaagcaatctacgttgtcacatggagggctggtcactgcctctcctttagttggcttgccagaattttctcatcttgggtggggccactggtttacacttagagatctggaaatggcaaccaatcgtttctcaagtgagaacatcattggggagggtggatatgggattgtttacaggggcagactgattaatggaactgaggtggcagtgaagaagcttcttaacaacctgtaaggatatttatttatcattggtgtaccctttaattttttttcttctgccactttctgacactacacataaacaatgacttctttttaatcttgttatgtaattgagttctgcattgaattcctaggggccaagctgagaaagaattcagggttgaagtggaggctataggccatgttagacataagcatcttgtacgccttcttggatattgtgtagaaggagttcataggtaaaaaaaaaaatctttgttttcctacattagtatccactacactttgtattatatttcacaaattcattctcaataatagtgccagctttgggtttatgatagtcatattctacttagtccaaaataggacataagcttttctctatgttatgtctctttatctgtcataatgaatgtgcttcctgattgatattcaggctgcttgtgtatgaatatgtgaacaatggtaacttagaacaatggttacatggagacatgcaccaatatgggacacttacctgggaggcccgcatgaaagttatacttggcactgccaaagcgtaagttcagggtgcaacttaaaatatataccatggtaatcatttgtatagtctggtgccaaatcactcggtataattatcttaaatctctcatctctgaattttgattgtaaaaatgtgttcctttaattaatgttattactattagtgttttatgcgtgtcaaaatatatcataaatattattaaatgtatttatgtttcttgataatattatgttatagactttatattctcatatagtttgcagtatatttaagcccattaggtttctagtctaaacaacaatatgcactctgcccatgggaccactgactatcttaggccatatttggatttaaattactaacaatgggtggaatgtgatggaatgaaataaatttaccgttgcattgttttaatattttatgatggaatggaattgaattagaaaaactggttacacccagtacccccaaattggggggaagaaaaggagcagttttgggtggaatggaatggattccatttcatttcactccattagttcaaacatagtcttagtgaacatgtgacctattgtagtttaaatattttacttcttaattagttacaaaattatttttatggaagattcaatgatggaccttgttctcccgattaaccctctattgtactgtgactggtggcaggcttgcttatttacatgaagcaatagaaccaaaagttattcaccgggatataaagtctagcaacatattgattgatgatgaattcaatgcaaaggtttctgattttggtttggccaaacttttggattcaggcgaaagtcacataaccactagagtaatgggaacgtttgggtatacagaaaatttattatctctttccttatttttttacttaaaggatttgtacacttaggaactcacttttgttttggatttcagttatgtggcgccagaatatgctaacagtggtttgttaaatgagaagagtgacatttacagctttggtgtcctcttgctggaagcagccactggaagggaccctgtagactatgcgcgtcctgctaatgaggtggctaatttttatgaactctgcctgcttgccagttctaaccatgctttccaccgtaagtgatcactgcccttcaaatagctgatgagatattgtttatcttcattatgacaggttaatctagttgaatggctcaaaacgatggtggggacacggagagctgaagaagtagtggactcaagccttgaagttaaaccaccactgcgtgctttgaagcgcactcttttggttgcacttaggtgcatagatcctgatgctgaaaagaggcccaaaatgagtcaagttgtgaggatgcttgaagctgacgaatatccacttcgagaggttcccttcaatatcttgtcttctcatacataagttctactgattagttaataactttgatcttgagtcttatatcacaattttgcatattttttaccttgtgtgcattcttatcattattctccttcgtacatgtattggctaacctaccaggctaccaccaactagaaagaacaaaatattggatgaactcaggaaaaaaattgggggtaaaatatgtttctgtttcctacaaataataattgttggttttagtcctcataagtcataatatggcataaaggtcacattaatgaacattctaagatggcatgtgacatgacatatttagatgcatgttaagtcatcaataaatcaataaatggtgatagagactattttcaaaacttttaacataaaaactaaaactaatatttttttttcaagaactacaaccaaaagtcgccatattaaacccaaaaatttgatattcttcaggctacacaatttctatttacttaattaccaccacctcagtatagctcaaaaacaaacagacaaacaaagcataatgttttgtgtttatcgtaacatattagtgggagtatgctgtttaattctgcctacttagcattctgatgcattatattataaagagcatggtcctcttttgtatgcatgtttttgggtgcttatatactaaatattgaagtattatatcttgacaacaaaacactaaaacgtaagctagacaactgattgataataatcactttcaggatagaaggaaaagaaagagtggcactgccagcatggaaattgaaaccgtgaaggatatttctggtccatctgatgctcaaaagatgggaatttctgaaagccacgttgaaggataggattgacaaccccatgacttagcctgcatgtacaattcccgttatacacgttatatatagtaacttatctataccatattgaaatatctccaactttgtgaccttaagaaaattttgtttcatctgaggatagaatcagatcaaagtgagcccgtttggataatgaaggttttgttttgttttgtttttgtttttaattgaatggttgccaatgaagatatgatacactagctagccttgcaaagagggtagaatcagtatgggtgctgtgagtgttagtgttttacagatgctacggggcctatcttcttacatgattgttgattttctttcttaacttccttgactttattatatcctcacatagtcactcgctgctggagagtggcgatagtaaaaacgaatacttggcttcaatttccatgtcaagtgacaatatatttttcaagcatcttaaatgggagttccttatgagattcttagacttaagaatcagtttttatacaatttcaccattagagtcaataattgtgattttgtatatggataattcatctatatcttgttcgttctaacaatattttccttttgaaagggtaaataaacgttgtttttttagagagatatttttagtgttttactaatctagtttaaggtatttaacatattgatacctaatgatttttagcaaagtggtgaaaatgtagaactcatgcaagaattttgttttttttttttttaaaaaaaaaattgtaacattaaaagaataatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaaaataatataaacatatgaaataacttgtgagatttgttttaagtttttaaagttttagtgtgttagtatatccgttaagttcaacataatgccaatccaaggcctaattgtgtaaaaggtctgttggacagcagtgtaagtgtgtaacaactttccaaacacagccttgcacattgaaaattttaaaacttatgtggtaatagggctgatataaattaagaagttaaatagcttgtggagatgttcttatgcagtattttggcttatttgtgttattttctcaacaattagattccttatcattactactgctgcttctctccccctccaaattattgggctttttacggttagatatagctaaggtttgtctctacagtcacttatgtgcttattatacgtgtagaagcaatgtccgtccccatggttcaaattccaacttgcacaaattatctgacaagaaatgggcattaatttttttcatttctaacagtatagttaattaagttttcatttcaagatggccagcaccgaatgatgcagtaccaataatttgtaaaagtggatgctttccttcacagcacattgttggttcatgcactaaaattgtgaatggctaatctagttatgattatcttttgattcttttcaacataatttttgttcctttccattgatgctagtgtcataaaggaatcttatctttcgcaaataaattaaattgtacaaacatttatgtggatcttagtgaaataatgagaagggaaaaacttttaaatttgcatgttatttcaatcctttgttgattctcttatttcacccaaacgaaaagagaatctaaacatgggagtttcttgaggaagcacttatttggcagacaggcaaacaaatgattcaagttgaaggcttcaaacggtggaagtggaatgcataattattcaatattctgataaagtagacctattttcacggactagaatctaggcttcttgaaactatctttctcttctgctacgtacccctttacaagctccatggggaatggggcaagttggcccatatttgccacatcttttgacttctccttccttcctttcataaacgggttgtttactgccattaatggctttttgaccataaagggctaaaaaaaatgagtaattaccatatgttaaaattatttattatttagaagtaagtcgtgtcaggtggtatgacttctaaatcaggactcatatcatctgtcacgacctttatattttttcatttttttaaagtgaagtcgtaactttatttataactttactgtgcatattttttttaggtttaaaaattgtaaatgtatttaagaatttaaaatcataaatatatttacgactttcaaactgtaattttttttttatttttacgctcaaaagtataaatatatatacgattttaaagtcgtacatatattcaggactttaaagtcgtacttttttttctcccttttgaacccgcacgactttaaagtcatgagcaatctcatgactttaaagtcgtctacattaaatattactaaatgcacctcttgtttttgataagtttctcactaaaaattgaaatttgctaattgcaccccgtttttattaagtatactccaatcttttattttaaatcttaaatttcaaatgctaatatttttaaaatatacccaaataattatgacgattgtgttaaaaaaattcataacaattatatttgtaaaaaatcattaacaaaatcaacatatttaattagtaaaatcaaaataaatatatgttatttcatattttacaagttaaaattattaccaaaatattttcatccaacaataaatctctaaaaatttaaattttaacattactacaaaaatttacaaaattaattaaaatattaaatgtaattcaaagtaattataacataaattattaaaatacttaataaaataacttaaaatatttacaaattattaaatcgtattacaaaaaataaaattacttgcatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactattggtggagtccatagtcattaacttccactcactacatagaagatttgagtgaaaaacttgaggcaactattaatagatataaacaaaatgaaggtcatatataaaatgcaaaaaacttaaactacaatcctaactaccataactattttaaaaatattatctttttaaggtaataaaattcaaattatattattaaaaaatagaaacaggccacgtgtaagacaattgggtgtgttgaagtttaagctttcccttaattcgaattcaaaatatcaattaaaaagttttaagtttgttaacagtttgttacaaacaaaaacattaatcagaaagagtaccgaattctttatggtccaaatcaacgacagactcatttacgggtgaagtccaaatattgcaatatctcacaatcctttttatgagaaaaaaacatttctttgtattggaaaacacaaaacgctacttttttgccttaactttgataacaagctctttggtggactatggagtatggaagaggcacaaattctaaggacatatccaatagtgattcttagaaggaaatattaactttaagatatgatatttttaagatttattattggagttggcaattagatttttactggaaatctggttcttccacaagaatcatcaagatccgcactgtttcctaaaaaaaattgtcactttgctaagtagaaacccacatgaagcaattaccacgaatgggaaaaatcgaaggaaagggaatagaagagatgaacaacagaaagacagatttaggtttatgagcaccatatctgtctctacatgttgttgatgagaataaagatggtggtattacaagtaaagaaatctgagatttgaataattctgtttattcctcatgatcatagaatgtacagtgcctatgcttatatacccaaaaagagaatcattctagacgctaatttgttgtaactaactctcctatacaacctcacttataaaaggaatataggaataaaagctacatagcactacaccacaactgtgcaggaaagaggctttgtcaatatatctgccaattgattatgtgaattaaaattaatattacaagtaaagaaatatgagatttgaataattttgtttattactcatgatcatagagtgtacagtgcctatgcttatatacacaaaaagagaatcattctaaaagctaattttttatataacctcatgtataaaaagaataaaggaataaaagctacatagcactacaccactattgctataacaaaaagtaaaatacaattacaaaaatgtcctatgcttaataggtggtagcgaagggaagggaggagagtgtggggggtcgtatcggagggaggagcgggtgagggtttgttgtgtagcaaagggtacgggtggggttcgcgacgaagggaggtgaaggtgggggtttggagcggagggagcagatggtggtagtggggtttgtggagggagggtggggtggatggcgcaatagagggtgagggatggggaaggtgagagaaaacagaaagggaaagggtgaatggtggggaagcgtgagagagaaaagagaaagaggaaggggaatagtgtgggggcaccattgagaaggaaaatgggaagaaggacaaggtttggtattcaatttttcaaaggataaataataatttttgtctttaaatgtgtagagtgctaataaatttgtctctaaaagatggaaattcgttgttatgaaatttatattgtaaccatattaggtataggtagtgacaaaatcaagttgaatttcatttttttaatatttaacttaatgactatgcaatttttgtttgagtctcatattttagaaaagataatgttacattagaaattttagagcaatagacaaattatgcttattaattaatattatatttattattatgtttgttataacttatgtttgttttcctatttttttaaatgtttattataatgttatgtttgtaacaattaaaaaagggtaaaagatgaagattaaattatattttgagtaaatagtcatttttcaatccctgtatgtgtagagcattgaaaaatttatccttaaatgcgtcactaggatcttttattaactataatagacataagttaacatatgaataaatttgtcatattttttcactttcgaatactaaaatttgaattttcattttttgaatatgaatttgttctacacattcaatgacgaaaataactatttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcctcttaattactatatgctgacttaactaatttaattaattttttatttatctaataaaattttaaatttctctagagtaattagttttcatttaattaaaaaagtagttaaaaaaaagttcgtgcattgcactgataataaaactatcttcttttacaaaaactgaccctacagtcctcatgtcttcttcctcttttactctagctttccatctcgtgttcttcctcacaagctccagtgttcgatctccaacataatcaatcgtgtattcaacataacgtttatgttggccaacagtaaaaaaatacattttctttgtgtaagtgtaaaatgatatcttttagaaacacttaaatatgtttttgatttaattacgttattattttttaattttggtatttagaagttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttacaataattaaaaatgaacaatttttttacaaagactaaatttgaaaaagtaaaaacttacatagacaaaaaaatatttaaatttttaaaaattattaaatttcttttcttttcctactttcagacctaacaactttatcttatttttactcaattttccttctatttttctcaaataaaacaactataattttgttatactctatttattatctatttctcttttcttttattatttacttgtttatactccctctatttcctttctctctatcaaatataaccgttttttacataattttatatatttattacaagcatactactgagtatttggacttctaaaatagagtagtataaatctatgctagtttccatattaacgagtataattatttcaaatgttgttagaagagtatgtaacatgatcacaacaaaaaattgttcgtgtgatcatgtccagtatcaacatttgggtgtatacaatcactctataattctttcctttccctcacttctcattaagcaaattaattttctatacatgagtaaccagatgtttcttataaattagcttgtttggaccctagttctaacatggaattaaaaaatgtaaatccaccttctgctactcttacttttgctttaacaagttggcaatattcaagtcacgttgattatgcaattggaatgtgatggaaaattgccgttttaaggcattgctttgaggttggaacttgcaagtcagacaaaacaagtctatttcaataagcaatagccacaagcatgtcactttttcaaccacggaatcgattcaaatatcaaaagtggagggactttgctagattctctacttctcctactcttttgccagatagatgcaacactacttcttctgtctgcatgtctaattccacgtcaactgataattttgatcattttttttcaaggctaatgttatataccataacaaatagttttaatattttataaatgaaagtattaaataaaaaataactctatatatttaatgttttaaaaatattactattcactaatattatttcgttggtatgatgaaattagactagattcttagttaaccaagacattgattataaattttttgaatataaaaaatatgattggatatgaaacttcacttgagctgatcgattcaacatttatgacatgataaaaaatccaatgtacaaataagtaagaagatttagtaggaaaataatataatttactcgagggattaaaattttatttttacaatgaattaattttaaaattttcacaatcatttataaattttaaaaaactttaactgcattgtaaaatttacttggattttttaacatgttttgtattcataaaaagattaaaaataaaatcgtacatgagatactacttcaataatgaatttatttctacaaaataggataatttttactgtcccacattaatgaaacacttcccttattgtataaagatatatgccttgcatgtcactcaaacttttattgggcaacaactttgtttgtatccgtatgtgactatgtgtagacaaatgaaaagccggtgttgtaaacaagttggacaaggacaactggtgcatttatatagctagactatcttttcattttttggggacgggttaaaaggggttaattttacaaacaaattataaaactatatctcttttgaaatattttatcatattgtggtagaaaacactggaaaactctaataaaatgtcaaataatattttagaagaaatattgatttatcaatgctatgtacttatgtagtgtccatgtgagacactacaataccagtatcattgttactattattgcagtgtcttatgtaatattaataaatcggaaaagtatatgtgacattgtttgattaaaatagagttttttagtattgattgtctcaatttggtgaaatatttcaaattatttaatactttatttgtaaattaaccctggttaatccgccttcatttttcaatagctaggcatcttcaaagtgaactacaatttcaagttagtctctatatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttaaaaaaatattgtgtataatattctatttaactcgaacaaaatttattctaataaaagatacatataatttatactaaaaaaatgaagatatattagaataaataattgatcttgattttttaaagtagcaaatattttgatgttgagatggtaattttgtgttgactaatcgttgataaatttaggataaactaaaagcacacgagactgacaaactgataaggattcaaattttgtcgcgagaaaggtgaagcttattaaaaagcttctatggcggcagagcaaacgataaatcaataatggaggcactcaatgattcattcatggaattaattaagacgctttggatatggtacaaagtttgttaattagttccgttaattatggtaaaccgaatttatagccataatgatttggacttctgcgatctacaaaagttgtgataatgtttaacgtgggaataaaaataaatcagttttttcactttttatttgtctcgtgatcatttagaatttcttttatggaatttttttcctcattttttcaaagttatcaattatcgaaatgaaattaacagtaaattatatcatttttttttatatttttaatgtttatatattaaaatgttttaaaccttggagcagccctcagctatagtcagccccgttagctccacctgctttgactttgtatgccatataacacccccagtgtgtcaaatttcaaatcaacattctattgtattttaagttttttttttttaatgttcagtactttaagatattacttattagtaaagaaattaatgtatttttaattaaaatacaatagaaattaataagttctcatgtatattaaatatatggataaaaaagggaactttgaaaattatagtgtaaagttttgtacaatataaaaaaaatactatatggttacactaaaagattgctttttgagattactattttaaattttacaataatataattatacataactaattaagaaatgatatatactattaaaaataaattccatatataaaaattacccataactttattgaagcgttgtaagcatcatcaagactttattgtcttgtcttttgaannnnnnnnnntttaatttttaagtagaaaataaataaataaactatgcccattataggcatatactagtatacatatataagttagaaccagtaaatgattttatggatatcacgtaccctagaacgtgcatttccattttccaaattccaaagcattatttttttcttataaaattctgaacttggatagctgtatggctagttggattatcattaattcatcgtaatcaattaaacaggatacaattaattgtgaaagtaattggtaaacgtcaaataattgtttaataatgaacatggaaaagttaagggtaactaaacctcattttatagtgtatgagatcagatgaaaagaagggaagagaagaaagagactgagaaacaatatgataaaaaaggaataaagaaatagataaaaaatgaagtagaaaaaagaaagttatattgcaaatgtcacagcattcaacagacattttaactacttatggttctttctaaaacctgacggcattaacttttaaacccatatggtctttgcaatatttattttagtccaatatatacataatttcaggcaatatatttcaatcacaaattcgagtttgtatctaaacatgacaacgggctaaacgaggatggacaggcatggccttcttaattaaccttcaatctcgactcttcaacatatctttatacgggttgaaatttattatttcatcctgtatttaataaaattatattaaaaatttgattttagaaaaaaaataaatttattgttacacatttatttttaactatttatatcaataaatttattgtaatacatttgtcaacaaaaatcgtcaacaaaagaatattaaattatgtaaaaattctaaaataaaattaacaagtaataaataaaattaagattaatacatttatcttccttgattctattgttttttaaggtaaacaaaatacaccaaatattaaataacataactcaaagtcatagacactaaccccatgttcattagttcaaattacaccaaattaaaaataattagaaaatgaaaacaatcttgatcatcaaaataaggaaaatttaaataaataatgtttttttaataaatattttgaaatttggaactgttttgaaactatttcgaaatttgggacagtcaaacatgtctaatttggacgtgtttcagttcgtcgctaatttggtcgctaagtcggtcgttaagacagaattagcgacggattttaaaaaacctcaatatcctttaaaaaagtgttagcgactaacttagcgatcgaattagcgacggactggaccacgtccaaattggacgtgtttgactatcccaaatttcgaaatagtttcaaaataaccccaaatatcaaaatatttattaaaaaagtattatttttaataatttgtctcaaaataaccaccaacttcaccaaagattccatcaacatttcttctggacccgatatttacaaaatcaaacatcatatatttagattttctttcaaatcttaaaattgaacatcacattagtaaataagtataattattaattcactaatcaataataatatctactaatcttgcaaatgttgaggaatgctactgaccaaagatccacatatattttaaattttttgaaaaattagataagaataatgatattaaagttttttagaacaactaaggattcattctcattagtaaaagttgattcttcaattgctctagaatctacaaataataaataacaatttataagttttaaaaatataaacaacgtgtgtgttgtaacttggaatctaaacaagtgaacagaaaattgaaaatcctaaataaagtaataaaagagaattttaataatttcatcatcaggacatatatgactaccggtgagtagtgacattctatttccaacctcgacctcaattaaaaagtcaaataatccccaaatccaaatttgtacccaatcaactcaagtatttctcataaaagtccaaataggttcaagccgatacccacgaatacgaattttattgccatgcctacttgtatcaaatttataggttggtcgtagatactcgtattagtataaagctcgtgaatcaatgataaaaaatataaagctcgtgaatcaagtttctttaaacatgaaaattaatccaatcgtattagttttggaattctaaaatgataatgctcctgaatattgaaagtttagagcataaattttgcaacaatgacaaaacaaacaaatcgagaaacaagattcgagaagatgcctgcaacatcaatttcttaatcaagaagaaaaattgtctcactttcttgcttttttttttcgttgtatatattttcttggtttatttgcgcttattttttaattattgtcttcgtattactttaattatcatatggctggcatggagggaagaggtacataccatttcgccatgttgataaagaaagagggttttaattagaatgtcatatttacacaataataagaatttgtatacttatctcaactctttttaaaaagtatattataaaaaaagccttaacatagagagtgttaatatagcctattaactgtgctagtttaggtttaagtttaagtaaaatttcgaaaaaattatccttttcagtgaatcatctgactaaattcaaataagttaaagtgaattatgaataatgaaagtctaaataaaaaaagacagtcttagtataacctcgaaagtacacatgcacacaagttaaaactacactacaacataaatacagagaaaattaatattttaaaaaggagccaaaaaaattataatttatctaattattatgatattatgatctatattggtataatatttttttaaaaaggaaaaaaaaaatatgtaaattacaatttcaaagtgttcatttatgaatatggcacggcatgaatattattttaaattgtctaaatttcttaagtataacaaagaattttcatgatatgtttggatttttaaaatatatgaataacaattatggatgtactaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatacacggtcttaattccatgtacctatatagttcttcattaatccccccataatttgtaatatatataaaaactgtaaaatgattgacatatatatcaaattatcaatgcaaaaaaataaggaccataaatagaaattaatcaatagctacgttaccatcgtgttataatgaaaacttctatttctagtagcgtactccttgaccactcttttaactgtgttagctagtgatccaagaaaccttcactaagtagtcctatcaatatatgtacctttcactgagaaagatcaatcatatatggtgcgttaatcgtcttgtcaaaaccatctttctccactacatattcgcaacttgcaaagtactcaaatgcaaaacacaccgcccatctctgacatttttgacaaaatttaccaaactatatttaagaatattaatcaacatcagtttcatctgcagtaattctaaatactcatttaatgctcttagatccccggccattaccatatagagacctgtctttcatttccatacaaatctaggtacatttatatatgacttaaagagagaaggagctaattaaccaaggggaagctactgcttaattactacacatacttatatataaacaatgtgaaaatacactgcaagctccaccatatgctaatagaaatgggttaagtgcatgtttaattctgtttatcttgaaaagataattattttaaaaaaaatcctagaaatatatactactaaaaattaataaatcagtgatcaaatttagtgatagaaaattacttttccttcaccagttaatttcgggatcactaaattttagtaacggaattcttttaaaacatatatagatcattccgttactaattttaatttttctagtagtaacataaaatataaaaccattatttttcctagataaaataaatcaaaacatgcactaggtttttagtaagttcatggctcttgtttgccagggaatgatggtagtaggtcttgcaataaaccacagtcacgagggagttggaactgctgctgctgttgaggctggggatggagattatgggaaaggttttggtgaaacattggattttggtgatcattttggctataacttggaagcaactgagcaagaaaatcttggggtaagcttgacgccatataagaggaaccaaaaaaggaaggtgatgacaacatgcttgcagcactgccccttagtgttgctggacagtgatggttgtgttgcccttcatatgttgtgatcacgattgttgggtcctggaatgatctctccacccttttctttacaccgcacttctgactcgtgcatctataatagctcctgcattataaataaagaatcaatcttccattcatacgtaaaatgtgcaattaattgatgagaagtatataatttcttgatgaattaataatttcttggtattgttgaatatatatacgtaagtgtaatattatggtcatatttacaatatatatgtggtatgtctccaatttcatcatcagatagtggataacaaaaacaagcctcaataagtacttataaataagctgttgcacaaccttagtatgacaagaatatgaatcattacatcgatatggcaacaaataaataaataaatagaagactttgtgtgtcaatatgtgatgattttggcacaccccaatattccacaacccttcttaatcatttttttcggctgatacaaatacaagagccctcatcatttttgccttaaaaggttaatattaatgtacaagtaactagattagaaatttcgaaattggaaaaaataattaaccttgggtatggactattcttgaccgctttctgtccatattttctccatctgtatccatcttcaaggtgatcgatctcacttttagtcaagaaggcaaagcgaggttctcttggctttttctctttctttttgggtttgttcctgaaacgctccaaaacatcagtcaaattcaccgcaagatggcagataatactcaccaaaccgataacaattattttagggttaagtgcctataattgttccacactctccaccattttagtcatacacacaaaaacctacacacactggatacagtattaagagagtagagacaagattgaccaaattcatttcataagagacactgaaagtcataaacaactgaaaagacacgaaatgatatatgggcatactataattgcattagtaaatactactaaatagtacattcaaagaagaaaattcaaaattctacataccctctagaaaataacagttaataattaataagataatcagatcctattcatgaattgttaaaagaagaaaaaagagaaagtctatgaggaaattaaaatcttcttaccctccattgatctataagaaatcacaaagaaagagggcaaaagaagaagaattttaatttaaacctactctttcttaggcttttcatctccttcttcacacccttttggctgcttatctttctggttcttggttgagtcttcttctatgattgcttcagcttcattggatgatgaagacacagatgaattaggtgttgattgttggttcccactgacccccacagactctcctcctgcactaggcttcttggggttttcatcaatattggaggagatcacttcagaagatgaacaaggcatgtcaaaggctcttgagagggtgttgtaatccatggaaccatgtaagcagtcagtgaaagtggtgtgatgatgagaagaagggttattatgatcatcaaacccttgatagtttaattgtgagccaattggtgctgagttgttgttgttgtccctaaagaatggaaagcttgatgatgagtggttgagttgctgatcatggtggtggttgtaatgaaagggatcataaaaacggtccttctcattctccatggaagagagaaactgaagagagggagaatgggagaaggagaaggttggaggaggaagggccagatcaaaaaataaaggtagctttgagaatgatatttcagctaagacttaaattcgatgtggttgcttgttatgggaaagtgagcttttggtttagaactttgtttttcttcttgcttttattcccttctacttttgcacctcactttagtgtttggagctaattggggagtgtttctctatcttaatctttctaaagtcagtgtgtggttcattttttttctaaagcaaatcaatttttcttctttcaaaataaataaaggaacaattgtttatatatacctgcttgtgcatgtggcgtgatttctcgatttaatagtaatacaccgtatattctcaaacaacatctaatcatattttacatatatcacttgtttacacacactttaatttgtgttgaaaaaaaaaatcttgtatatcttttttttgtcttatgagaacgttaaagttgtcgtcgcatgactttaagcttaagagttcaaatcttaaaaatagtaagttgctttatttttttttctgttcatatattatgcaatttgacatattttaaagggtgtaaaaaagtatataaaataattaacatgaggcaaatattttaatcctcaaaaggcaatcgattcgagaattattagtcagttggttgaaagatttattacctatatagttgatagcgacttctcaattaattgaagcactcctttattaatttatttgatcgttttgaatctaatcaaaagagaaagaaaaataacaagttgaataatgcttgcatgctaagatgtttctctttttatataataaaagataattgatgttatataagaaggcaacaatgctatgtattttattagaaggtttttggcttgctttgtaatgtttaagaagaaaaattaataaaaacctcaacctcaaatttacattttgtgttcatttgagctccacgtatatggcttggtttggtaggatcttatatgatagcgtgattgattatccttctagctagtatgttgacaaggcacaataccttctagctagtatatattattacatttctaaatacaaataaataatatgtattattacataaacaaatgaatataaataatttgtattcatgtacattagcattactatcattgttggagatagtttttgatagagaagggaagtgtcatgggggggtcgtagtcacgttgttaacaagggagtggagttagtcaagaattccgactataagcattttgtttttgtaattttggaggtttattcttacacgtgtcatgcgattgggcaccggcatttgaccggagagtgacacgtacgagagactcgttcgctgctattgttgattgttcagctccaacgcaaattcttcggtatttaaaaagtaagaaaaaacaatacttctatattatatattaattaaatacatgaatccatttagatataataataaaaaataaaataaaaaacataatgtataaataatagtataaatttaataatgcggatttttattctttctataacaacaagaagggaaaaaaaaaaaaaaacttatgctgttcctcatcacgcctagcttagctatgtctatgactatggctatatatgtgttgctgagtgggttttcacgtcccattccttttttccctttctttctgcccgaagtttgtggcacgcatctggttccctttccctcccttatgccttatcatatgctcatatgctcacactatcacattcacatcaaatcaaaagaggaaaataagatggtcaaatgtgatgtatatatccaacgccaaccccatttccccactcttctgtatttataaacttctcacttgtctcgtatggttgcatacactgtttttaattaactataagcaagagaataagtctaagcagatccaaacaaactaatgtttatgtatgtgcaataggactttatatacatgaagcatatcaatgtgtgtgtaagcattaaggttgttttattatgaacttttagactttagctccatatataaagtttcctgtcctcttttaattaattagatgtacaagtcaaaaaattcaatctaaagaatagatcgaggtaaagaggagatcaatctgctaatgaattattaattaacttcaggcgtctcataagacgaatcaaagtctaccattagtcgaaataattagatccttactatgttatttaggtcatctctttatatgttgttattcattcacactcttccataactcaattagcacttagataataatatattgccccttcaagtgtctcctaacccgaatttacgatggaaaagatatctagcatcgaatgatttctaggatatatgataaaatagtagaaaacgcctttaatttaatttttagtctgagatcttttgtacatggctacctttttttatttccttttcctttttcaattcagaaattaaagactttttttccccacttcagtgtagactagctaggagactctaaaatagcaattttttagataataatatatattgacaatctgcaccatataaaatatagactgtaaagtttattatcaagcctatattggtgcacttcttattttgtcttgtctttataaagtagctaggcagtgtattgatgtcaaaaggactcactatttctttatttgcttaagttttttaagaaaatatataaataatttaatttatatctattgttagcgttaatttaaccaccacaccattcttttaattaatatatgtggtgattgggtaaaatcctattgtgtaaaaatatgttgcaatacatataacttaaactaaaaaaataaattattaattagatttgattatgatataatatttgaatataagttagttaatctgattaaaatatgatagactcatttaaaagcgaatatttttacaaaacaagaattcataactttatttgaagattaccatatacaatacttataactacttaaactgttaacaagtgacagtatagcaaaatataatcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattcgatcgttgaatatataattaaactttctgacattcattccttcatgtatagtaagctgaaaacaaaaacctcgattgaatcctgggatgttcactaatgaccagaccctcaacttaaagctaaagctgtttgttacaaatttacaataatatttaatagcaaattaaacatgagagttgagacctctttttaattgaaaaggtccccttttggagacaaaccggtgaatgatcccttaaaaataacagatagggttactgaataatatatatgtctgctccttctcaaagtaagacctcccattcccaattcccatatatctaatatctctgagaagaaaagttggtaaaccaaagacttttcttctgtttggtgggtgcaaaaatgcaaacccaacaatcagagcacatcttaaatgtccccaccaaaccaagctgaaaggaacgtcgataaaaggaggatcaacatctttttattcttgtattcatttttaagtaaataggattcatgaatttattgattcattttatagtatgttatattaaaacgtgtcacgcctaatataactttcatactttggctaatctacgtattagagtcatattatataggtacccctgttattgctatccgtgtttcttaatccaaacataaggtttatgacaaaaatgaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacatagttcatgatgttatactatattttaattagtggtgtctaatataattctttaagaatatttgatgtgggagttttaaatatgtatatttagctgtcgatttcatttctcatcgagttttttagatttttataattaattaaacaaaaataaatgataaagtattttaaagtatacaatggtaagcgagatttttatttacgtgatagtatataggtagagtatgatgatggtaatttatatcattaggcgcaattttatcaattatcaataaatataaatttgacaaacaaatatatttttattagtcaagtatacagtaatttttggtacaaagtagaatataaagtattcatatatattagaaataaagagaaaagaaaactaaaatagaggttgtagcatcattgctttgcctttcccttgacttgactccgcctgaccacggaccacaggattttattacaagctggaatttttagtttaactacctgagttaattaagctcaaataataatactacattagattttattaaatatatagttttaaattatcaataaattatatctgttcacttatgttaaaaaaataataataattaaagtgaatatttgttattatgattatatgatatttctttatttatggattatttaaataatcttacattataacaaagttaattttcttttaatatgtatgttgtgttgaccaaaaaaaatcaaaagaaatggatggcaagcaagatttcctgggttcatgattatatccttctttctctgacaactgaaaagtctttatgaggagcatgaaattgttgacatatttgaatgcttttgtgatggattagacttggtaacttcaatccgatcgacttgctggcattcatcccgtacaacgttaatttgaatgctaaaagcaaaaaaataaaataaaatagatcgagatgtgattctcttctctctagctatctagatttcttttttgaatgatctctatctagatttaaaatctaagttttcgatgaaaattgcaaaaatttcttgtcaacaataaggcattaggttttttaaaaaagttatatttatcgtaatcaggaatatgatggaggcgaacaaaaactttaaaatgagttaataacaaatgagactcatcaccaaaatttatttaatttagaaataacataaggaaagtgataatatcctatgatgtacgttttaaaagaatagttactcttaaccaaatgtgtaaaataattatgattttattttacttccttgtttttgtttgtaaaaagaatgaggaagaaagtttatctatttattcaagaaaatggatgtatatttctagttaagaatctcgtatgatttttatttctttgaaaaggaattttttgttttgaaaataaaagggttgtaatgtctggagtccacgattgacgtggcgagtaataccataatgagtattccttgtcagccgtccatcttaatcattcttgggccacgagcatggatgttctccatatggccaatcctaggcagttaggccattatgcgagtatctgactgtcaaggtggttacaccattactaaagtgattgttatactattgcaacaacctctcagttaataatctaggattttcatccatcattataaataaccaggtattatattcactgtaattgaattgtattaatatattactccttcaaacgagcataaagtttcttttacgagtacttctttgtcatttttcacttttgaaatatactaattttaatcatttattcatttaaaattcggtatatacaaactttgagtacaatcaaagtcaatatgaattcgagacttgatcttatcgtttaaatattattttgacaaattgataaacttttcaaagagttaatagatatatacttctatcctatatatcattgtataaggactttcatttgttgcttattgaagggtggtgcgatatgtcccaaggacatgataaaattgttatgcccaccttctaatagttcacaccaatattctttacacttttaaggggaaatattcacacgaattacaacctcaaaagagtatgttggtcttccttgtgtttgtggtgttttgaatatgtcacctataatgattctaacactcaagttaatatggttagaatcaacttgagttagaatcaagggacgagagataagttgataacttatcttgcatagagtgatccaagatatttgtagtatttttttaacttaacattaatgataaaatcggttaagcattgataatgacaatgattgaaatattcttggagagacattcataattagttatgcagctattggtgtagggttgttaccctacatgtgtaagctcttatgacgtgtgattgagctcttatggtaaatgatttcacctaatgtgccattttaaacatggactaggagttcaaaatatgaataaatgaagaaaataaaactttgtaataattgatgagaaatgatacttgtaaacaatttgtacaacaaatcttacaataaaaaaagagaaaaggagcaaagtgagaggagagataaaattttaaaatgtaataaatgataagatagagagatataaactaaaatgatgtttataaattattttaagaaatattgtgtatgtattgtatctcatgattgtataattattaactttcttatgatagatgattataaaaatatactattcataaaacaattagatagtaacaacacattttataaatttttccatgaatcctatttttaataatttaaatcttaaaaagtagatttagtaaagagtaaaagattctccatgtaatcgttactcaagggaagtgattaagaaatatataagcaatttttttaattgaaatcatattaaaagtgtatttataacatttaatggtatattttttatttcattttttacggggcaatgattaataagatcacgataagaagaaaaaaagaagaataaaaaaaaaaagataaaaaagaagtataagttttgtttaaaatattattgagatattcttattatgattttcatcacgctcaattaatttttttaataaaaacttgtgttatttatttaattcgttaatagtcccgaccctaacaataataacagaagtgttgaggtttattaacctcctatctaaaattcttagccaatgtaagagaaagataaattttgtgttgtgtctcacggtccaagtctaacgttgtggagcatagaagagaaagggatgatattgaactgtgttagagtgacagttatgcctatgatggctgttccttcatggagacccacgtgctgctgcgcttcttcttcttcttcttcttcttcagtttcaaccatcaacactgaccaacttcgttctcaacttgatcaccttcatgcagaggctgacgccacctgagccaagggtacctacttaacttacccatctctcttattgttcttgttcattcttatttcattctgagttactttctctatctgaatcaaccgtgtttcctggacaacacccattacagccagtcccatgaatattatttaagtttaattttttttttttttttacttttccactacaattctcaccaaaagaattgaattggactgctgtctctaaagggttcatttaaagattgaggattgaggcttatattgaaataattgtgtggtggttaacgcttaacagcaactaatgctagattgaggcttctgcgactgtcagaggctgcagagaagcttcaaaagcaagcggctataagcgttcaaaaggggcaggaaaattatgcaagggaaatgctttttcagaggaagaaagtgttgcaggctttagacaagtctaaaatattgaattgctcgatgagctttcctccaagctaagtgaggtaaagtgtatatacattattgaattcatcagtactattgcagtatcttgtttgttgccagttttactttctattgtaattatgacaatatcaatacatttgagagagaacagctctgttagattcttaatgtaatgtatggccaatatgtttgaggaagggatttattcaactgtttgtgaaaaaaagttgtgatttgtttaccagtagaggcatgaacaactgtagaagggactgcatatatccctctcaagctattgttttcctctctatgaatatatcaatctgttttctatgctcatttgaggaggattcccagttttcatctggtttgtacaatgattgtctcaatttttctatcttaaatctgtatttcggtatgttccactgactgatggcataactgtgcctgtcaacctagactatcagtgttgaatatctcgtgtattttaaaagatatgtttgttttgcgtctatgaataatgtttattcccacccacactctgtatgctactgttgcttttactcaaaatgttcatattttagtaactgtataatgaaagaaacttattgtgggttcacgcaatatctttgaaagaaagtcagctaattggaaatgttactgtgaacgttgaagacacaacagaagatgcttcaagtccagttcgaattattgctccaaaggaggaagttcaaaatgatgtcactaaggatgagtcagatcattatacagtggaatttggtagcgataattccaaagtcttttgaccttattctggaatcccttagtattttgaccttattctggaatcccttagtatcagcactccaaatgaagacaatatagcgagaaactagtcagaaatatcctcttaagaggacttcatggatcatataaatcaaaaactcagtgaaattgaagctgaactagtgactgttttgaatgtctcaaccttggtactggataatgaagagagaccaaaaaattctaggttgcaacaaacaattgaactccttgagagcatccatggcattagacagaggtataacacttcaatctattaaagcataattcttattgtctcctttgaagatttaactataaaaatcattttagagtaggtgctctctagtgattttgaattattgatatgaatatattcatattaagcgaaaataataaaaaaaaaaagtaacgcaacactttttcaaatttccaaactcacagaattagaagtaccaaggaggccaaactgaggatctgatcaattttgttttgctcaactcatcttctgcttccaggtgagaactaacttcgtttgtttaaaaaaaaggtctgccacaattttcttgtatcccttaatcacttaatgtggaaacaggaaagacacatttgagatgctatattagtttattaaaatgaaaagaggtgttgatgttttgatttgccactattctttccaacacgcaatcatctgtttggtcatggaggagaaacagattgagaaatttgactaaggaataaggatagccgagtgaagttgcttgcccatgtccttaacttgcattccaaagtcttttgaccttattctgtctcaaaaatgtaagtagtagtgatattttttggaggattccatgagatgtcctttgtgtgtaaggtactgttgcatcaattaccctgcaagttaccacctaaagttcttattgttgccatgattcatgagaaattagatattaaatcatccatctactttgtatcaagcaggctaaaaggcgtggctttttttttgtgtgtgtgagttttaaatatggcttccatgattcacgatttaatatatttgtttcatgcaataccataaactcccatcatgtgtttgagtttacacaatccatgcatgatgcgtacgtcatatgatatcaggagcttctgcaactgcggatgaaattattctgtttatggactcgtgtaaattgtgtttaacactatccatgataggtgttgtttagtgtttaactcatttattaatcactgactgactaaaccatttgtttcagtattatagttattattttagcagctgattttctaattccattatttgatgtatgctacaatcctaaattttcgtacactaattgttataaaaaggtggcattgtcactgcatgtatcaaactaattgttatagactcgtaaccaaaacttagcaatttgcagaaaaagcttcgtggaatgttgagaacaaaaaatgtattctttaactagactgcataaatttctgtgtgaactaatgtactatgagatgtctcatgcatgctattctaaacgtctgaattaaggcatgttcaactcaggcctccatgagtggaagggttgaatttttattaacaattaaaaaggttaacctaaagttaacttctcttacaaatttacttgctcacaaacccacacgtggcagccatcacagagggagccattcagatggacagtcccttcttctccgagtctaaggtagctttatgcaaaaaacgttttcaaaatttattcagagtagagtaccactataatccaaattgtatattctttttacattgaggtatgtgatatgtgcctagcacatgatgtttccaagctcaattgaatcattaaatgcatcattttatatgataaatagatttcaattggtgtgaatgtaacttatgtgcttcaatgaggtattttggtctagattgaatgtttagcaggtgattagctaagaattatgcagagcagaaggtatggcgcgatccgcgccatctccgcgcgactagcgccgcaacctctggaacctggcgccatcagcgctaggcccgcgccatcagcgccacagtttcttcagccagcgccatgagcgccattggcaccattccttctggatgttggcgccgtcagcgccaggaccgcgccaggagcaccataggtcgcagagtctacataatgagggcaaaacagagatttcactggctactctataaatactgaagcctcagcactgaagaaactgtggcttcagtatttatatagtagccagtgaaatctctattttgccctcattatgcagactctgcgacctgtggcgctcctagcgcggtcctggcgctgacggcgccaacatccagaaggaatggcgccaacatggcgctcatggcgctggctgaagaaactgtggcgctcatggcgcgggcctggcgctgatggcgccaggttccagaggttgcggcgctggtcgcgcggacatggcgcggatcgcgccataccttctgctctgcataattcttagctaatcacctgctaaacattcaatctagaccaaaatacctcattgaagcacataagttacattcacaccaattggaagctatttatcatataaaatgatgcatttaatgattcaattgagcttggaaacatcatgtgctaggcacatatcagtatgacatcacatcaagaaacaaatagaactagcactacgaagtacaaataataagggcacccatgatcttatgatcacaagtattggtgcaagtaatggccaatgcttctatagttctattcaccgaatatccgtatttcatgcatatgggcaagtgacagcaaatggttggtaatgatgtgcaatacatttataacatttgaccaaaaataaataaaaataaaaataaaggatgaaataacactaaggttatctttgtggcctgatgatggtctcaggttttagtagcagaaacagtcactctacaatagtggtagtctcgtatattgctcctgcccttttagaagagatgtttggatttattagacagtttccatgaggtcagcaagagtaatcttgccatacatgccatgttccaaggaatcaaattgtttgcttatttggagaatgtctatctcagtaatcttccccatttgcttaagcttgtatttgacaaagtcagacttgctgcaccaataaaactaaaatggttaacaaaaatgaatgaaagtaatataactcagtagtcagtattctctattgaactgaaaatttctgcatcatctttgcatgcggattgaggcctattggctcaaccaggtaatctattttgctacgttgccttctcatttgctcaaattagcacgtaaatttctatattgcaacctatatgtttcaaagacattgtaaaccaaccatagtggagttatgtcattatgcatcgtgagaacccgaaccgttgacgcttgaactttcatgttccatcatcaatcatttagctacagatagttcctaaggtcaatctgttgttttggttaactcagacggaagagggtgaaatcatatggccatataagagagatgtgaaaggacttttaattaagaagaatcaaatttacagtagagcattgggacaagagtgaaagaggttttttatttatttatcctctttacaacatgataaattcttgatttaaaataaagtattccttctttaaggttggtctaagatgatgagggtcttttgatttctgtcccccatcatgcttcttttattgtgatttgtaaagctaaaacaactaggaaatgttcaacgaacctgatatactcaggggttcccctttgctaatttatcaacagatctaatttatcctacaatttcttattttctaagtgactaaaacaggctttagcgacgaacttctagtaatcttctgttcactcttgcttttgattaggccttgacttcttatagctctctttgtaaccaatgcacagattctgctataatccatttctacaagcgaaaaaatgacaaggaaatatattatatgaatatgagactacaaacattcaggcatacctgattgatccatcattatcaaggtcggcagctgctaaatatgataatgttatcttcttctgaagaacccattgtgccatcttacgatttctcttgtgaatactatattcagtgaggtatataaaggccctggcaactgccggtgtgcttaccaaaagccatataattgcaaagcatcttccggttactgttctgagagaaaaatccccataaccaaccgttgtaacagaagtaatggagagataaatactgtcatcccaattcaggtcctcaactaagtgcactgtgactgttcctatagcaatgcagccaatcacaacagccaaagcaagacaaactttggttcttatcctcattcttcctttctcttcatcaaccatataagtcctgagaattatcttatatctattctcatcaatcatgctcaacaagaaggcctcttgtgtatcacaaatgtattcaaccaatctattgagcagaaaaccaagaaatccaaaacccaccaaaatgaaagcacatgtaaagatcttggtaaaagtggagtcaggaaagatatctccatatccaatagtgcagagagttaccatcgtaaagtacacagcatctacaggcctgaaagtggtattacccctgaaactcccactagtcatgtacactgtcaccccagttgccacatacaagaaaacaccaagaaaagatagcctcactattgaagttgatgacttgtgtggttcagagggctcttgaaaatccacccccatgtcagtgaataataaagatggtgcagagcgagagcgatggataatcttccctttcttgaaagccaagttggctatgaagtgcatagaagtcttggcttcataggtgacatgatgagaactagattggaacagtgatggggcaagagcaagagcaagatcatggatagatagttccccaggtgatgatctgtttggtgagtctgcttctttcctagagcaagaactcaggagggattcctgcatggtgcattcaaattgtagttggggactagtgattacaagctagtatcacagcttctttaaactactagtcaaaccacagagaagattggaggatacatgtatattgtagctgagagtcataactcatatagcttccttgcacaaactttattctaataaggagagccagtgagtatttttaattttaatttaaagtgacgaattactaatattgaagtgtcttatattatatgccccaactagaaccgaatcactaaattctattttgatcccaactacgtggaacacgaaccccttgattgtatgccccaacatttggagtccaggactgagccatggcaagctagagtgtaccctaatagagaaaaaggaagttagttacatctacttttccttggtggtactgatactgcaatgccgtaaataattgattgattgattagataaattataaatgaggagaaaaaactgatccctgtaaagtgtaaagtaatacaatatagctgtacagggaatgagttcgcccgattgcagaggatagctgcttataattaactgaattatcagaaacagttggatgcagttccagtaaggtggctgaaaatagacttccaacttccaagagcaacaaacaactcatgaaatatcgtgttgccatttcttttttaaactttttccgtgtgtcctaaaatagttccttcagtgataaaatcattattattgttaaactattgtggattcatttgtaatcatcttaatctaaccaccaaaaaattattacccagagatgtcaagagataaatcatttctcaagtcaaatcaaccttggaaaaaactattttttacatttcaacatcttttattggtaacacctaataggctagtgacaaagacagcaagataattttttgagccatatatccatagccctacaaaaatctagcgactgcacaactttgacatcatgaaacgatgatttgcaccatttggtagccgaactgctgcagtttgaggagcatccttgtgaggcaccgtttttcgtacttgtgcatgagtttctgcttcatgttgaaacatcctgactagctctcgaagctcttgttttctcagttcaacattttcttcaatgatgggttttttcaggccaagataaagcaatccaattccaattagcacgacccctagaacaaagaggatcacagtgaatagaagaaaggcaaaaggagttcctgaagatcctggtattccctccacatttatgccaaatagtccagtgatgatggaaagaacaaggccacaacccccaaatattcccaagttatgggtgactgtgaggcttctgtcctaaaataagtaggaagagtgtgattattcaacataataaactcccctatactctctattttctatatatcatcaatgtcaatagcacctttaatccaagttaattaggattagtggtagatgaactcaataatagatacgagaaggttggaaaaaaaggaaaataagataaaagaaaagaagggagaaagatgaagaggaaaaagactaaaaaatgattatctagaacatagaaataacaacagaactaactctctctattttctatatttaaataaaaataaaatgaaaaactggattgacaccaacacgcacatgaatatatgtcaagactgtttctatgtagaattatacaatttcatcaagtatcatgtatatatttttgctaactgatgtgtgtacgcgcacagacactatccgagtgtactactacaatttttaatttgcattatgaatgcaaaagtgatataagaggcaattaataaatatattacaagaattactttttttcttgattaaaaaattagagtaaatccttattttagtcctccaaagataaagatgccaatcctagtgcattatcattccttattggatacaaattatcatgcaccagtaataatgccagataaatcttttgcacacttatatagctactgtattaggtacataaataaattcaatgaaacactagtagcttactaatttatagattatagttcagtagttggtaaaaaattaaaaacctgcaaccatgcccggactgagctttgcatgacatcttggattatgaataagcgacctcgaactgcttcttgctcctcaatcatttgtcttgtacttttcattactccttccagcaacactcttgctgcatttcctctcaaatgttgaagaagttcaaaaacaatttcctctcgtgcatggactgaccatttcactcttataacctgttaggtcatacaagagataaaggtataaaattttgtgtacacaatttacataattacttatgtacccaattttattttacttttacataattacttatttaaataaattattagagcagtgcaatcaatgaaattgtgcgatatgtaaaagtttcactcgctacaacatttcttatttttatttaacaaagctacagtttgtagcagactctctaccagtacagtattagtcatgctgtaatctgcataattacctgggttgataatcttgtaatttcttggttcagtattatagtgaacagatgcaaatcctcatgattcctcctaccaggaaggaaagaacattgtgtatccaagttacaaacaaaaaagataaaatgcacacctatgtcgcacttaagttcttatatattttataaaaaaaaaaaaactaatatatagtggttcaaagcacttgcaatcacctgttcataaacatcaattcaacttcatctgcagccccaaagatgtatttacgaaacaacctatgatatcatgtgcattagtaagaaataattatgatgacactgcactgcatattagataatgattttagatcacgatagaatgttgaaaaagtaaaccattcacaaagatccaaaacttatatttatcaccaagaaaactgattaatatagcttatgctaataatagcatcagattttaagaataggaaattaatcagtttcagagaatattgttaacaacaaattaaagagagagaaggaaacagggtgaaattacaaccaaattcagtctaaatatatcaaaatgaaacaaacaaaacacgtacataaattaatactagagctaaagccataggcccactacccagtttgatgccccaaaaagcaggatctatgagggaaattctatgttgaactaaactataaccttgtgtgactgaacagaaccttttgacagtagtaagaacaaacaaaaagggggattctatctttctctgttcaattcctttctttttattctttatatggcaagtcatggatttcttaatcctagtttcactctctgttcatgcctttcaagagggcaatgcattccttctaatcaaaagtaactggttttctctatattattttttcttggatagaaataacaaaatccaagaataaataaatcttctatgagattaactttttaagtcatataaatatgatgaagagtttacaattattcataatcttcacttccatgaagaggatagaaaatccatttactgaatataacagatcatgaatttccactacacatgcaacatggtggcttgcatcatgacacacagtatgtttctctttagcatatatgcatatgattgttgactatgaaaaggaataaccaactgcaaacagtagttgttgaagctccagttgcaacactcagacaacccaaatagacctaaatcatattttgaacttcatacatttggtcttaatgtgttatccaccagataactttatcatgttccttcaaattctgacagcaagcagataaagcaatttcatatattctcccaaattttatacatactcttttactcactcagatattcgttacaaaaatatttttttcctccattctgcgtgtaatttaatcatatctaactagcaatagagcttagaaatagtataccaatgtatatatgcttgtatttttcagatagtatccagatagcagtttaatttgaagaattacaattcttgtacgctttaccttgataaaaagcattgtctaataaacacacgctcttagcaatttagatattcatagttcaggtgtaaatttaattacaccatttccaacagattcaatcaagattatgtttatctgatatttggaagttatatatagaattagcagtggaagaaaacaaaatcaaaatattaattaaagggaaaacagtaatcatcaacagcaaaaccaatagaaaatctaatttggtaacaagatataactaatactaacctatcatcccatcgggcaagtcggcaagctaggtgtgctacaacctcatgaatgctgcacggtatgttagcccctcctgcagccagcagttcctgtataacatagttgaaggcaactaaggacaaaaatagtaaaagaactatacttctggcggaataattctttgattaaggatttcaatcctccagagttactctcagaactgcatgaatcccattcattcaatttatttcattatataataaattaatatcttccaattaaatttaataaacttcaattgttagatccacaacagccgaggatccatatctgactgtctgatgaatgagggggcaaaaagactaactgacctgaacttctaaaacacctaacacattgatatttgaagcagagcccttaacatgcaaagcagtcaccaaaaagttttgtgcctgccatgcccgtaagacaacgggaatgtcatcttcctcggcaaatggatccccagcagactgccctagaagttcaaataataatcctccagcaacacgaactggaacctatcaaaataaacatcaataattaaaagcttattttataaaatcaaatgccttttcacctttacattgagtcattgatttttactgaaagaagcacaacaaccaaagacattttctgaagacaacaatttgcataatggtaacagcaaataaacaaattagcacaattcactttcagtctcaaacatcactagtttattcaattacctcatacagaaggtgtttcattctgtcactgattaatctactttcttcttgcaaagcaatgctgatggcaggatgcaaccagcgagaactaccaaaccatgcagtaacaaaaggatcagaagcatccaaatgacaccaccaagtgggccccaccggccgttcccagtaaggagttgctacatctgcaacaggaacatcactctcatcatctgtgaaatcaaaaggcggtgaatcaccaccatgtactgcctgaacaagttcagaaattctatcccaaccaattgatctccagtaactccttggaagaccctcgttgcaatacaaatgaggtgacactgattggtaaatctggtcaccaaaatcatctccatgtgattcattcaaactgtttccaattctccctacgcaataatcactctgattgccttgaaaccccttcttcttggtaggtccctttcccctcatgaattcaaatgcacaaataagtccattagtccaaagttccccaccctgctgcatgttattgttagtctctctggtggaataatgggttttgtgattcccctgattcttcatttcactggtaaatgaagctgaataatcttcattcacagctcgcattttgctctcaagacgaggaactagagcctcctctaccattgatgagagagttaaatgctaatgaaaatcaaagcatcatcatcacaagaaataaacaatcaatgtcaacttgatcacgatgatgattcataacataaaataaaacctcagaaactagacaaattaaatcaatatcaatcacagggttcctaacttagtactaccttgccataaacattaatgcaatgtctgcaaattattatgatgatgatgatttcaatttggatgcaaagcacaaaaataataaccacatgcaacaattaacacaaattaactgttgaataaaattgaaatggagaaaaagaggcatactcgaactaaagagaagagaagctaggcttttatttatcggagaagacgaggagaaccgctacgatggtcatggtcacactcagtcacggtcaccaactcaacctctttcacgtaacgccaacgttccattaatatatgaaatataatgttgttatatatatatatatagagagagagagagagaataattttgaaaaataatgaaattatattattaattaaaatatcaaaaattaaatatatttactatttcaaatatttttaaagaaaatactttgaataatagttataattttttaaaaacttatataacttgtttataatttgaagaatattgattacataaataaaatataatttttataatttagttatattattggtttgccatccgacacatacaaatatttgataggattaaatttaggctaaaatgtaattatgatccttctattttttttaatctataattttaatgtttttattttaaaattaagatatttgattcttttatttttaaaaatttataattttggtcagattctcgatttttttacattttatttcttatttattttgttttggtttaattgaaccctaaatctaacgtactcatttaaaatatcttcaagaaatgatttaattaattacaaagtaaaagataaaagaaataaaatgtaagcaatattaaatcataattgtaaattttttaaaatctgtagtcaaaattgtgtcttttctaaaattattttttttaaaatagaaaaactaaatgtctcaattttaaaatagataaatcaaaattacaaattatgtaaaatagaataaccaaaattgtatttaagccaataatgacttaaataaaattataatctctctattttatttatgtaatcaatatttgaattatagaaaatcaataatttaagcctaaaacttacataacttgtttatcatgtttttattatattttattcttaccctgttttcatatcccaagtcacaaccatgaaatgaatcattaacttaataagctgaaaataaattcaacaatttattagtagagattgtcaagacttacaatagtgattgtgatggattttatttatttattttgctaaaagtgatttcgatggatagagataataattttatttttactttttttaaggcaatggaatgtgaaataaataatgtaaatacagaaactcaaataattaaataccgtaaataattcaaataataacttcgtataattaatattaaatagtaactcaaaaggtacaattttgaaaaggtacaccaatccaatttagtgattctaaaagcaaactacaacaatttggtgaaaaatcctttttatgactccctgtgaataatgttttaggtttaacttcaagtggtaaggaatacgatctttggtagggtagagaaggcaatactgagagtgaacaagctggtgtgctgtgcagaaaggatcaccttacgtgactaattaattctaatggtaatcttattttattgcttaatatcatcgctttctagttaatgttgcatgtatgtatattgacgtgggtttcattattgttgctttgtctttcaatatattgtcataaatatttgcaatttatgtcagaacctggtgaagccactgaccaggaagagattgagttagtttgtccttcagttacattaattttccatagcatctgttatgggggaacatacgaataggtgagtttttcaagcaatctggttgttcacgcgtgaattcaaaggaattatgttttttatttaattttgatcatgccgtgtcgtatacaagtgatccttcttcaacagtttaacttaatctcaagtaaacccttaaaattgtttaacccgtataacaatttagtccttaattacaattttaaaaataatccattaagtccttctcaactttataattaaaaagtcactttcatacatgcattagttgtataataatatatagactatatccctaaaaatttgtatgtgatatgaaaatgaaactccagagggattatgcaaaacatcttcaacatgcattattaatttgtataactcaaattattccttaacattgttatttacagactaaaaatttagaattttctttgtaaatattatattttattttaatttttcattagaaaatgttaattattatttttgttaatttttattaatagaaaaatttaaatccacaatttctctcctcctttatctttttctctgatagtcaaatcaaccttataatctcattttacaaattttatatatgatgtgagaaatgaaaatattgtataatgatgacacattggtataacactgtcgatcatttgaaaactgcaatatagaattatttgtctgtaaaattgatgcagtgattccatatcagcatttgctcaagtttctggatctggaatctcatcaagttcaagccattttccatgtcaaagtcattctgaacacccaattactggcaattcacaaacaacaaacatgactgcatcatcatcaagggctgcaatatttgattttcaaacagaaatggtggatgacctactttcatctcttgaagagcatgaagagcactcaacagcaccatatgcccaagaccttattgtgcagtccccaaagcactactactttcaacaatttataagactaccccaaggtcttcaaatagcaatcaagaatctgcagcaagcattatctggtaggactgtatatcgaatacaccaatcttggacctaatttcctcccatgcatagattgcctccaatagaatatcatgcatttggttctcaaattttttcctctcccatccataacgttgtaagttcaatctgtccaataatccatgcatgtatttcttcaagtgacttcaataagattttatcataagatctactttaatggtttaggcgttgtattatttcatgattctgctctactaatacgaactagatctttattgtcattaatatcagcaaggtttcctttattgggtcatggagctggaccaagatctttgtctttatcatcacattctcatcagattttggctcccttaccgtatacacttgtacagtctcacattctggctccttctccaccaacaagtgctgttcattctcatattctgacttcagaaagtcctacaaataatctagttctgactactccacattatacaagtcttgtacctttaccttctcagaccctatacatccaagaagaacttggcagcaaggagattttcaagatttgtcatccgacggattacatcgaaattgaccaacaaactaccactgacagcagcttactttctacgtattatcttttttctatatttctttcatttttgctagttgcagagcctaactattgaaaatgtacaatttagtttttaataacttattaattataagaacagtctcttatttaattaatgacatcttaacccttttaaaatatttatgttttctatttttagacacgattttgaatttttttataattattttaatgtataaaatgtatttcattggattcatctacatgaaaattataagaatcaattaaggatttgtttgataagtttctttagaagtacttctaaaagaagaaaataagaagaaaaaaataagatgaattttttcataagtaaaaataagtttttcattaactaatttttagttaatcaccaatataatttctctagaatatgagataatatctacaaataaactaataaataaaaaagtttatttcatttttttatttttacttttttttctttctaaaagtgtttttagagaaacttacgtccaaccaaatagactctaaatttgaaacaaaaagaaactttgacaagatgaaaatttcataaaaaatgagtattatgagtaataaaaacctgaaaaatctaatatttatattcttttctcattgataataaggctcactttttacacggttttcattggttttagtcgttaatttttttttttaattggttttagaggcgtcgaatatttacaggttgtgacccataataagtccaattccaattctattgacactaaaaaggaatccatgcttgatgcaatgcgagaggatccaaaactaatcagatgtctcagaatttgtatatgagaagatctcaaaattagatgctacgatagcgtctcaaatgttgaatatgcagtaaaaatcgtgtggcttagcatatatagcattcaacgtgaattcctttctaacgtctctaacacagacctagtgaaaatcaaccaatgtggattctttgaaatagttttacttaatttaattaattagttttgatttaaaaatttgacttgcattttaaaactacaatctagttactatatcaaattgatgagatttattttttctaagattattgtcaccttattaaaatttaattaaaatttaatttttatatatcacattaaacatacacaaagataatatatcttgtttcaaataatttatttccataattccttccacaattttagtaatcttatatctttaatttatttactatatattaataaaataaagtgcctattttaatactaaaggcatttttaatatttttttcttcatatgtgtaaatttatcatatttagtaacatgatattttccttacatgttttaatttttaaaaaaaaaaatacttatactttggaaatatttgtgcatgtcaagatatgtttgtgcatgttttaatttaagactgtggaatacaagaccagacttggatcatgtcaagattccaaaagcacgagagccttctattctcccagtcttctctacagttatgcataacataaaaaggctcagagagtttgctagagacactgtgaaacaaaggctccaaacatgttggaaatgccaacaaaggtttgtacagttggtaagaactgagttcatattccataaggatatataagttcattctattgtcgatgtgaaaactttggtgagagatgatctataagcatctttgtaagcgtttttttgagcctcgagacctccttaggtcttggtggaagccggtagtttgcatgattcaccacctcttcacctccctccggttcctcaacctgtccttcaatgcattatccagcaaagttctttaaatctcaggactcagcagacacagaacaagacctcgagcagaaaggagaatttcaagatttgtcatccaacagaggccaggaagaacttaattgccttggaagccattcttcttggtcacgcttcctctctgtcccctcatgaactcaaaagcacaaataagttcattaatccaaagttccctagtggaagaatggtacagtgcaagaacattgagcatcaaaactagtcaagaaatcactagcagcttagtattttccacatatcactcttcactgtcattttttataattagttgacaattgcttatgcggcaaaaactgtttgcagtgttagttgcagagctaacagaataattgcagtgttacttggccgaacagaattacacactcaatgttctcttcaaattcccctctctttccctcttccttgctcttctttctctacactaacttgacttattttttgtcccgagggagtgaaatagagtatttttgtcattcatatgtgcgtgagcgttcaattgtatatgcatcagacagaactgaacacgcatatcatgtttagaacaaaggggcatgcaattctatattattataatgtgagaaaggaggtataggtggctaatattgcgaagtaaagcgtaataattatatgccatgagatatctgttggagaaggcaattgacatgagccaagttaggcagagttaggctgagtaatgcaaaaaacaataatttgtggttggttggcattacttaactccatcctacaaaataatcattcttttgggatcctataaaatttattgtcacaattcaactacataagcaattctatgaagcagaaaagagcgatttgctctttgttactgcacattttcctcaaagtgtcttatgtttggtgaaatggatagaaagcaagaacaagacaacggaaactcaaacatgtctggcattgatgtagctctaatatctcccaaagtcccaaaagcagtttcaccagtttcttctgcagcagaaggggacaccttaaggcgaccacgtggccggccggccggctccaaaaacaaacctaagccaccaataattgtcaccagagatagtgctaatgcactgaaggctcatgccatggaagtgagctcaggctgtgatgtgaatgaaagtttgttgaactttgcaaggagaaagcaacgtggcctttacatactcaatggaacaggctgtgtaacaaatgtaacattgcgccaaccaggctcagctggtgccattgtgacccttcacggtcgattcgagattctttcactgctggggtcaatccttcccccaccagcccctccagggatcacaggcctcacaatttacttggcaggtgctcaagggcaagttgtgggaggtgctgtggttggtgctttgattgcttcaggccctcttgtaatcatggctgcatcattcatgcatgctactttcgatcgccttccattggaagatgatgaacttgcttctgcaatgcagaatcagcattaccaaaatggacgcacccaccatcttgatatttctgacttgtatgcaatgccacagaacctgctcatgaatggtacaatgcccccagagatatactcttgggcaccagggaggaacttctcaaaaacctgaaacttagcatactatttgttagttgttgtctcacattcacaaatgtactgtactgtagctatcaggggtcttccaaggttgacattgcaaaacaagatgatatgcttattctgatctattaagaattattttagcaaattaatgggtgtaatgattttcaatacaataagatctacttttcagagttaatattgcatattgcagcattttgtgttagaacttcaaagcaaaacatgcatattccacagaagttgagattggtaagtctagcaaggtttgaattacattcactagcaaaaaagcaaactttagttatcactacactaaaccagctaatagtaaaggttgtataaatatcaatactaaatagcttttttctgaaggcctaaagcaacagtttgagtgaccttatgcatggtttagccctgcagacagacctagattcaaatttatacaagcttaaatagacatcacgttttctaattaagttaccaatatgactggaataatttgggaagacataatattataacaataatgaaatggatttttgcatatttgaatttcatgtcatggccctgtgcccctatcttactctttctactttaggaactttttttccctaatcaaactaaaaatcccagtgtattgacaaacaaatcggatatatggttcgattgtgagatcctcatatattgtaactcttctctgtattagagctacttccttacatacagattgatttttaaatttcacgagttcatcccttcggagataatcaatcttgaagtacaaaactggagtcattcagtaaagagtaaatctctcgagctttaggatgtagcctccccccagccaagaactcatgaacctctccatatagttctattgaactgcatcctggttccttctctgccaatctttctctcatcaaaattctttgctccattgcctcttcaaattggttggatgcagcctgaacattagacataagtaaataaccactggcatcacttggatttaactcagagactctttgtgcagctcgtttcgcaatttctacattcccatgcttcctacaagatgaaagcaaagccccccatataataaaatctgcctttagaggcatacactttattagttgttctgcttcttctagtagcgcagcttgacctagcacttcaaccatgcaagtgtagtgttttatcgatggctcaatctcatacttatccatcatcagtgcaaaatagtcccttgcttttcctattgctcctatatatttacaagcagttaaaacaccaatgaaacttatatggtctggctttaaatctgaggcttcaagcttagagaagtactcaattgcttttctctcataaccattcatggcaagtcctattataatggagttccaacatgataatcctcttgtgggtgatgcctcaaacacttcaatagcctttacaatagctccacacttgcagtacatgtcaataattgctgtgagaacaatgacattcaactcaaaatgacccctttttacataatcatgaacccactccccatgtttaagtgctcctaaatgggcacaagcacttaacaagctcaccattgtaaattcactaggctcaaccctttctccctgcatcttgcggaaaagctccaatgcctccatcagcctcttattcctaacataaccactaatcatagaattccaagtaactctggttcttgtaggcatgttatcaaacaacctcctagacttatcaacctccccacacttagcaagccccataatcatagaattgcaagccaccaaatcaagttccagaagttcatcgaacactctcctagcctcactcaataacccactattagcatacatgtaaatgatagtattttgaataaactggtccttctcaagacccaacttaacaaccctcccatgaagctgagctccatcatagccagcacccagttgagcataagccttgaaaacagaagggtaagtcaagcgttgtggctgaactgatgaagaacacaacatatcaacaaaaagagatattgcaagatgtggggttgagctccgagagaagcctctgatgatggtgttccagcaataaaggtttgggcttggaatggtggtgaagagcaagtaggcatagttgatgtcaccggatgaagaggcgcagaaagtgaggacgcggctagcagcaacggtgtggtgagcaaggccggttttgacgatgtgggcatggatcttttgaaggtctttcatgttggagcattgggtttggagcatggtgaggcatggttggtcggagatgaactttgctatggagggtgatgatgatgatgatgataatggaggaagtgcagaacaaagagttgacattgtcattgtgtgtggtcgggactaaggaaagatagatgatgagtggactctacacttcccttttgagctggaaagtcataactaactagatataaatctgcaaactgtgggactactaaatatataagaaaaaaaaatttatcccctctttataaaattagaaaaaaaaattataaaatgtttttattttagtggattcttttaaataattcaggaatcaatacatgattataaaaatatgaatgttttaatattcaatagtttaaagccaaaaaaagaaaggaaaaatatttaacaaatttgtttgtccaaaaaagtcaaataatattaaagagtgtcgttatctttttcaaaattattagattagtcgtgttttacttaaaaagagtgtctttatgactttatctatttttttctttagttttattttctaatatttttataacattattttatagtattttcctattcaatgaatgtaatttaatttgtaacgcacattgaatttgtaggaaaaaaatctgggtttgatcttgcataatacatcacttggaaggtatgagaaattttagtgtgactatgtttgaattgaagattagcccaataactaccttaaagattcaaagtttataaaattacttagaggtttcagtagaaagataaaagctaaaattacaatgattaaaaaaaatagtatttttctaatgtctgaattctattatcgtgcattttttcttagaggttcttttgtaggttatttagcctttttcaagttgtttttaccattaagctccaaatgaattacatgtcaaagtatttaacttgatagttaaattatgatatttgtggccaatgcgggttggcagattggttaacaatccagattgaacttttatattttccatgggtgtggatttgaatctccttgatgtcactttttctggtaggtgggcatccttcttcaaagagatcctttgacatcttgtaactaattgagtagttgtaatcgaatagagttacttcctttaggcaataaccctctattggcagtcctaggctcccagcatgtcactgatattttgtgcagtagtatttgaagtatctttccattctaccattttgaacactaaaacgaaaatgtgatatttgtataagaaaaaattgactaaaatataataacttaagactcaattgcatttgattcattaatatgggtcctgtttcgatataagctagtatttttttagaacttttttattagaaatatagtatttttttttcagtagagaaattctcaaaaacacttctaaccttgaattcaatcagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattattttaagtaataaaagattttagattttaactttattgtctatcattatatttataataaaaaaaaaaaaacttttatgatcatgccaatcaagaagcacagtttactcaacatataacaaataacattattttactttaaaggcaatataaaattgagaataatcttgtcttgtatgacatgatctaagtaatttgtagtggaattcaatgactttgatacaattatctagttagttcacttcaatatttaccccaaaaaaagtgagttaaactcacttcaataaagtttgacctttatgctgatgaacaaacatgggacatgggttgggctgcaatatcatggccaccgttctttacaacaaaagcatggaatcagctaaagttaaaattatgaaaaaagctgataggaaaatcaaatggcagcaataggtagtgacacttttgctcctgcacgtagaaatcacggtcaaataccaattaacaacccaaccgtgtcacaccttgattgaaaacaaaaatatcataactaaaaagaatacttttaattttcccttgatttatgaacataataactgcatgtgtaaaggcaggacatataaaaaagagagaaaatgagaaacacaattttcatatagaggatcttaggaagaagattgaatatatggagcgtttgagcaattttcattcgtgagaatcatgttttttttaataaataattttttaattgatcattaaaaaatttaaatttttttaggagttaaaaattatgatttttattgattattttaattattttccatattatataattgaataaaaaataatacgatgattttattgtagtaaaagaaaaaaattaaacttgaaaaagtaagttttcacttgatttggaagttttctattttcatttaaaaaaacataaaataaaagtaaaatacatttatttaaaatttagaaaatattttcaaaaataactaaaaacaacaaatcaatcttttcaactttttttgaaaaaatgaaaatgcgaaaacattttaaagtaatttcttcttggtttatatttttctaaatcttagaaatttaaaaatgaaaacagaaaataaacattcataaatacttttgagaatttttttaataaaaatatataacattttcaaataaaaaaattcttataaacatttctaaccttatattcaaacaaacttataattttatacttctccaacaaagtactaacataatgcaagtcattttatattttagatttatatcctattaagaataaaggagaaaaaaacaagagaagaagaagaattagaataagtcatagacaacagcaaaaggagaagaatagaaaagagaaaggcaaactggacacatcagcaccatcattacaatcatcacttacaagcccacaaaccgagtctatattccaaacaattcttcctttacttcgttttcaaccttcttccctaccttttccctcctttttgctccttctcttgcttgcaccctccaacactctccctcaccacaccccgtttttgctttcttaaaccctctcctttgtctcagtcaacctcacagtcttccactaccactatatatacttttagttgcatgattaacccacaaaacaaccatcttcctttttttccctctctagttcatcatatcttcctttctctttcatttagtcaaaggaagaactactattactggggaaccacattgaaaaagaagtgagagaggacaagcaagtgccaaagaagaagaagctgaatagtaagattaaagatggaaaggagtgtattttattatgtaatatttctcttaatgtgtcatttcctctgttcaggtaattccctttctctagtttattgtatagttcttcttctatcttcttcttcttttttatctttggtttagctctgatggctctattctgatactgtttcttaattctcagtgtctttgattctcattttccttctttttcaaatttccaattgcttattctttatctcctgcacatattctgtgtttttctctttaatttaattgttttggaccccttgaatttgttttgaattctgaaaccacaaaaagcttttttcttctctcaagtttgcatctcaattgttttattctcttctagttttttagttcaactagtaccattatggatatacattttggactgattaggagaaaatcacttcttttttttagtttgatagtccaccttggcttctttctgttggaatatagtttactaattgagcttttcacttttttttgtttatggataataagtttcctagatcaaaatattgtctcttgtattattccattaaatacttgttccggcaattatagagccacaccatagaaaagtttaaacaagtccttttcttgctaattattctggggtttcacatagtacagttgcatccaacctttctccaattccaccgtttcttgaaaagatacaaagggcccaactgctttgactcacatatgcctctctctacataggataccctacctgtccttaactgactgcccttctagttgcactattccaagttgttgccttttgaaatgatggagaggtccaagtcttcttaagggcataaatataataattagtttggatcaaaatttctacaactattccaatgaatagcaaaacagattttgttttccataccagcatgaatgttatacttataggcacaatttgaatctagttacactttttttgcatccctttgaaaaaggaaaaggcttggattgatttcaaatctatattttgatttctctcttcacatgctttggacatatagtacagaacaaagtaattcagttgttatttcaaacataggttcaagtaggacacaaaaggaagtacctgtacatgtgaatgtactaggacatgatgaagggaaacaagaattcactgcctcaatttctacagtccaaagggatattaccactcccatcaccaccattccaaacttagttcccaccatttcaacatctccattcctgaatcctaattccaatccaggcacagtctctccagcctccacaatcccatttaccactccaaccactgtgaattctccaatctcctcaggtgcaagctggtgcattgcaagcccaactgcctcacagactactctacaagttgcattggactatgcttgtggctatggtggtgctgattgctcagcaatacaacctggtggaagctgttacaacccaaattccatcagggaccatgcttcttatgccttcaataagtattatcaaaagaatcctgttccaaatagctgcaattttggtggaactgctgtcatcattagcactaacccaagtaaggcctttgctgttataattctcgttgcaactttttcaataacgttacatgtattttaattttaaggcaagtccaaaggtatggtcaagtcgttgggtatattgaaaattcaaccaaaaattaggcttgattacaactcttttccttactttttcaatttcacaacatctttcaatattttttttccttccaaatttgagtccattattttagttgtggcatttttatttatctgtttacttactaatatataatatttaatagaaatgtcaacatgtcactataatgcattatcacattaatattttcatattgacgtaatattctattactatattattatattagtatttatattaaatattagattataagttgacagataaattaatgcataattaaaaatagagaccaaattcacaaataaacaaaaaataaaataacaaaatttgtaaaacaaaaaattaaacttagaaaatagaagttgaaatttagtagacgatgaaaatataattataaatggaaaggagaatgcaaactagtagtagaagaaacgtgtgccacatagtttaaaaaataggttgggtgattaagtcatgacattgggttattagattattggttaaattagtgaatcattaattgattcgtatgattcgatctgtaataaaaaatgtaaaatttttatatctatcttaaaatatttctcctgatatatattgaaattcaaaaatattaaaaaacacatataaaatataaagaatacaagttaaaaaatgattattatctctaatatttaacattaaatacatcaacgataatatatatcaatattcatattaaaatgaaacataattatatcacatcaatctagattataaaatataaaaattcaatccaaagtttcaaatcacaagtttaagaaatgatttgagatcacaatttcacttgtaactcaaacacaattgcaatcatgtttagatcaatttaactcaacaaaaaatgcaattgcaactacaaaaatgctcaacaatgagtgaaaagatcaatttaactcaaaatctcacacaaactaaaataaaacaaaatgaaaaaacaaatctaattggattcacttgcagctctaagaaacgttacaaatgagacgaagaaatgagaggttgtcgagcggagcaactgagtaagattactgagaagaaaaagaataggatgataaagtttctaaaattaaaatggatttaaatttaaattacgttattttgattttaaaaaaaaaaaaaaaaaaaaagtgaccatctctggatcgatgggtcaccgttcaaccaaaattccgaccgatgctttgggttagaaaatgcaaccaattgaacttgactcaatcctatgcaactatcgaatcgtgattcaacttatcgggtcgatttgagttttaaatctctggtgtgccaaattgatacagagagaggttgggtcccttgggttggtaatcagacgcatccctgcccatgattgttaggttccttccattctaaaaagactacaaaaggaagaaacttttattgcatatttgaattgattatagcctgtgacttggggttggggatgcagcagctacaaagctgacatctgtgtgatgcaaaagtcaaacttttattcaacttttttggaagcagcatctccaaaaagcttcctttattggccaattggggtaattttttttcaaatttatcatttgaagataaaatttaaattaatattttaaaatgggtaaatggtaggtaatttattatttttgaattaaaaattataacatgtattattatttcttttttacatgaaaatcgtaaaaaaaattattttttattattttaaacacatcttaaagtagtaagattattttttcactcagccaattttaaagttgtaattttttttcttttttcattaaaatcgtatattattttacatcttcaaattctttttgtacttttcttaattataagtaatttttactttaattatttaatggatatttttagttttatttaatatattttatattttatataatattttatttaatattatttattaatgttaaagactattattgattttgtaaattaagaaaaagtacaaaagaattaaatacctgttatcacaaatagtatctataagtagctattcatcgcaattttttccattaattgtgcttatatataccttgcttacgaattatacagagaaaaataatattagccacttatattcaaaatgaagtaacataatgctttgtacaaaatttatgaactcagtggttaggattatttacggataataattattttttaaagattttaacttaaaaaattatgaaaaatatttcttcaaaaaaatgatgatatatacacaattattttagtttctttttctcttaattgaatgccttgcttatttaacgaattataaatttgtaatattcattctcacctcttacctgaccattttcataacaatttttttcgaacataaaaatatcttttatgtaagattttgaacaaaaatattgaattcaagatttgatctttattaaatttctcactaaaagagttaaacatatctttgatatggagaatgagtttttttttagaagaacctttaaaatatgcatattgtttaaaaaaaatactttcttcctcttttcttcttatatctcaaaataagatctattactaaagaaaaaatgaaaaaatcttgagaaattttcaattttacttgtgatattatattaaaaaatatataaaatttcaattgaaaatctaatattaaagatgcatttaaaaaatacttttgttacctttatcttgtacagaacatatacattaaaatttgatgtacatttttgttttattttccagcatagaacactatgctcctccaatattatttaatttttggttgttgagaacatttgatgaatgcatttacgtgttttgcaggcactggggcatgtcaatatacatcaactaggtgacccaatcttgtcatatatatgctttcattttttttaatatacatatactatgctttatttgttaatgttacaacaattggaacagaaaatatcatattaattaacttaataattggtacctaaaattgcagcactagtacatcagtgttgaacacaacaaactcaagcggtgccaacgtttttggttcagtgccagtgcctacagaaccctctccctatgctgctgctgcacctgacacattaaatagctttgcagatatttgtgtcgttctgtggataatttcaactttgcaaagaaattatctctgaaatggttgagagttggaggttgctgctctgagtaaataatttttgccccttttagatactttttgggagacacaaaagccaatagctacatgaccatcaacagcacataaatggtagaaacatatggtagaaagaaaaggcaatttcagatgatggacatctgtagaaatatatactgtacataccttttttattttatttttgtgttgctcatttttttacgttagaattgttagaactcagaaaaataaatatatctttgaagttgccttatgaccttatctgtttagttatatgaaccaggatcagttttcttgtctaagctaaggatctacatctaatctaatttttaacaaacagaatggattacactaaaaagatgtaaatttcttacatatataagtgaccaactcatacaaacaatttttctttacgttttgctttatataaaatatcattatagaacaatttgaaccaataaaataattgttgttgcacaatttgaaatataatgtatacatgttgatttaaaatataatttcttagatgtttatttttttccaacgtgtagttaagatcaatatgttggcattacaaaagaatatgtgtagtggtgggtaccatcttttgattctgaccattggagtttgttcacatggcatgtactgaaggcacatgtcccttactcataaattctcacaacttcaactatgcaaaacaggaagagaataaacagtcccaatgtcccatgtcatcctacaacgggtttagggttacctttttcagtcactgtacaaccaacaaccttctttaccttcacaagtaataacttgaactaccttctaggaacatgtcactcaccacctattatacttggagtaaatcaataaggtaaatactaatcatttcattaagaacactggttaagaaatttaaaataaaaatatttttattgagaaataaataattatactgtccataatttttattttattttttatgatttacataataaacaataaatattttcctcttttaattcttaactaatgaatgtctttaagacatcagttagtaaaactcattgaataaatgtataatatatagtgacctttaaattcacatcttaacttattttaaaagaaaactaatcatcataaaaaaaactaagtttatatgaattattttttaaaataacttttgtaaaattaagtttgtttttgaaagtaaagataatttactttttttaaataaaatggagtgtaaatacatcttaacttattttaaaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaactgtggattcatgattgtgtcattttaggaccaaaagtttaatgtattgttaaatttaatttaacaaaatgatgcttttaacaatttttataggcatgaaattattgtcaatactataatagactactttttaaatatattcattgttaactgggcctcttattcttattattgtccctcaacggctcaaccacacccaaaatgatataatagactacttgacagttaaacatacatttaattatttgatctactaactaactaatagcagaaaactaatttcataaataggaaaaagacaaatatgtgtgcatgtgtataaaactctttattatttatttatttttatttgagtttaattatttatagttagtgcaaaatatttttgtacaagtatttcataacttatacgtgagttttgttaaatgtctaaatctgatgaaccgacattccatttaataaactcacatagtcacatacccaacaacaaagagtgttataagaatgttttactatttcttgtaacattaatactcatttacgtttgtctaaccttataagttttttggagagtgatattaaaaattggtaaataagttccttttataataactttatagaacaaaatgcataattattttaaatttcatagtaaaaaatgactcaataaacaaagtttataactatcataaaatatgtggctgttccatggttttgtaagatctttatgcccaagtacagtcttaactttgactaaaacattgtttggcccatagaagcaacgtgtcttcatatttaaagtcttgagcaaaggggttggtgtagtcttgttagtttagttggtagttcccctgaccctagtgcaatattgcttgaatatgcctaatgataagaataggataacaaaaatatcttaccaaggctaaattctaaattcttctattttattaacatttcttcatcatattgctaaaacctttttttttttactttttaaatttaattcatgtcatgaaaaaaaatatgatgagttaattaatcaatttgtttacaaaaaggtattaaattttgactattttgtcaatgtaattttgttttttgcaatatttatcatatagtaataataaagtgcatacaatatcatttagtgaatattagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaataatcacttaaagattaaaaaatatataataaatatacacatgagcaaagtattaatttattgtatacactcagacatacaatagacatgacttggagtgctcctcttattcttattataccttgcattgcatgattctctctctaatttgttgttatttattgcattttacttagtatatccgtcacaatagacacgttccttgatataagtacacatgctgaacattttttaagatgtacaatttcttttaatactatctttgtccctgtaaaactcttctaactaatttacaagaattaaaaaaaagtagttaattcaatgacattaaatttactaataattatgtcatctttatacaattattttatggtaactaatcatatcatttttttctttgttcattccatctaattaattaatgtataaagaaaatagtggttatagaattatcttctccaatattcataagtgcaaagaagaaacaatttacaatatttgttatttattaactaattaaatttatttgataaaaaaatattaattaatataagagacaattctttttatataaaaacactcttacaaaaagtgaaatacaaatttggtgtaagttatgtaagcctcatattcctagtcaagtcctagttactttaaagaagcacagtgtacgtaaagtaaatatgcttgcttgacactgtcattccgttaatatcacaatcataaatgtcatatccaacaagaacaaaaaaaggaaaagaagaaagaatcacaaaataaggcaacataaaaataagtgtataaaacagtatgacatttcaaaatatcattgaaaaatgaaaatcccatattttttttttcatatctatcaatagtattttctccacttgtcttcttgcacaatcccttcattccctgccagcatcatgtacttatccctcctagtaagtgtggtgcactcaaatcccaaagcacaagccaactgttgctgtatatagtttgccacttcacagcttgaccttcctccagcacatgttagttccttgggaacctttccaagaacctcaatataatagctaggccttggattcatgagaaagaaaatagggtccaagcatttcaaaccacttgctgttgtcccatagaacatgctcacatgactattgatagccacaggaacaatctcatcagccaattcagcaaacagtgagctgaaccttagtaaatatggttctctacaagttgttccttcaggacacaccactaaatcaccttctttgaggagcctttgcatggtttcaccatcttttcttctgtcccttgttagtctcactgtcctaataggggctatcaactcagacactttgcttaggctgtatgtgactgcagtcaaaggctttgccaaacatgtgcttaggaaaacaggatcaaggagagtcctgtgggagcatacaaataggacccctttgttttgctctgacttttcatcagggacattgcctttgacttgcagatttataccactccaaacccctaatgccattgcccatccataaggaagtagaatacccaaaaggattctataaatggctaaaagaattcctaatggaaaccacataaacatatatagagttgctgagggagtaggcaggaatgctagtcttccatcatggaatattaggggctttggatatttgtcccttggcaacactgaactggggttgcccttgccctcttcattgttcaccacatatgcttcctgtcattatcatgtagctggaattaggcacaatacattaatagatttaataaaatcatgtctactaaattacaatctaaatcaagattttaaaaaaataaaatcatccgtgactgcaattttgaccgcaatgtcaactcaaactataacaacattggttacttttgttcgtaagttcctacaatattaaagatcgtgacacaatcgagacaatgactgcaggttaaaatcttgatataaatgcaatagatttataatatgctgtgctaacagaacttatcataaagggaattaaaactgttcaccagaacaatacgtacaggttatatgttgaactttgattggtctttgttttttcaatttaaatggttttgttttttttattaaggcgtgtaataaggtctcaggtccttgatgggttgtggaaacagtgaaaggttatttaagaacaatgaagtattgaacacgcaagagttaaacagttagtgaggtgattaaacagtggagctaacttgagacttaccttgcaaagggagagaaaaagatgatcatgaacactagagcttccaaccccaatatcaggctttgtgtctccaaaataatccttcagtgctctgtgcttcacaagtaagccagaaccagaaaccaaaccactgaagtagcaaccaacagtgtgcaactctgtgccaacaacagcaccgacactcaaatactccctaagaaacccttccaccataactctaggcacactagtgaaaacaactttagaccctgctgaggccagaacctcataagcatgaaggttgagattctccaaataaaacttgggcaaaacagcccttgacatattttccatgacacttgttcttagcccacaaaaggtgatgaaggtcatgaccctaagacttaactcatggtctaaaatccacaacacgggacaagacaagagcaagaggagtgcccttaaaatgctgccaccttcaaaggcaacaagcatgaaataaggaaagaaggagtgggacctcaaaaggactctatgaatgtcacaagcaacgagtgtttgtgagcttctaccctccaaatcacatttggtaacactagggaaagaagaaggttgaaggggtggtttagatgacaaatagcccaaatggaatccataactcttcatttttcttgctgctctataacacgagttagcaagcagctggtacaagacccagtctgcaagcctcagaagcaccattgggaacaccatgctattttttttttctttcaaattggttgatggtgatgataaagagaaggagcaagagagtaaatggaataagaagagtgggactgtgtctatctgtggtgaagagcaaagtgtgcagagaatatttatagagtcattaaaagggtgcaggagaaagttttcatggtagcatttggttaaccacaccgctggcaataacttcaccttccacatttttttttttcttttcttttgataccatttttaagcattggccataatagtagcattttttctttcatgcaagtgccctctacatgtttgccagataatattagcttggctacttgacataaatacagtaggtaggttaaaatgttggtgaccgcttaagagagagtctttgtttgaaatgttggcccaaacacacactgtgttgcctattttaaatgacatcggcatgtgtgtatcatccctttgaaaagcccttcgtcaaataaatttccatccaatacttgttccattttctcttgccacaggccaatggcaagttagatcacccacatcatccaaacaattgactttttaaaccaattgcagaatcatccctagtcaaattgttcctatcaataaaaactgtcgttgactactagttctagttctatttctatattctgaaagaacattgatgatagtactcagtagtgtcttggctaaggaattaagaataatttttaattgaaatattatatttttcatgttttttctctctttatgaatatgtgatatatatttaaaaaatattttttattatttagtaagtgtccggtccggacgtgcgggttagtaagatttaattcttttttatatatatggcttttttttattgttagataaaatatatgtgtaattttatttagtgaaaccttgtatatataaaagattgtttgaaaaactatgttgaatggtagtagcatttttttctttttattggaaaaattttatattaagataaaaaaatgttaaaaagctacttgatagttgaaggttgataattgaaaattgaaaattaatatattaaataataaatatttgataaaattaattgttgaagtaattgaaaaatataaaattatttaaataataaagaaaatatgatttataaatatgtgacttatttaaaaagataataaaaaaattggatagatatattcaaaataaaaaaatataaaaaattataagttagaaactaacattttaaaaacattattttaaataatgtttaaaaatatttaaactattaaaaaattattaaaataatttatttatcaaacaatcaaataaatttataattaaaaaaatttatataaattaattaaaatattttggacatggcagactaagtattaaccgtttgactctgttttgttatgttgttgtctacggctctatgcattccattcccaaggctatttactgatcataggtgggacagttatagggtttgattttaattgcttaactaatctgttgtctgtgacgtaattatcgcaagtcccgtgatttcatttgaaattaattgtttaattgagataattaggcccttcggcaaaagcatactttctgcacagtctgatatatctcaggagttacagtgacttttgcattatattattcaaattaattaaataatagtatatatctcattctataagtgtaattgtttaatcattttatctgcatggtacttcttttacattaaacactagacgcatgagtagacttatatgttttgactgaaaatattagttattcgtcacttcaacttaaatgaagccatatttatgatagtaatattgtgatgatttgtacttgagaagtgagaagctagcatctgtttttaacattttttgtttttgttttgccataaataatttattgtttttgccatttcgtacaagccagacaaggtaggtaaaggttgagcaaattattcaaaatgtaatgacatgccattggtacacaatctttgaaaaccttatggaacttaattatttctttgctgttctgtttgttcgtgtgacggttagaacaccaattcatgtcaccctcattttgtggtttggtgaacccttaatcatttgatatggctgttcaatgcacatagtttgcatggaatcgttaagaagattcacgtatctatggcttctcatttcatttctgtttacccttcttgcgtttcttgagtcaataaaataaaatacaagtttccttaaattatttgtattactgaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataagagtcgccaaaggaataaaaactcgaattgataaaatgattttttattatataaatatactttttttcccttttatattatctataattttaagagttttacattagtttgttcaagaataattctaaattcttcaaacaatgagatattgcaaatagcatgtcaagcaacaatcccacttggtattgcttgcataattttccaagccatacacaattgacacaaatacgtcactttcctaaataaagctaaagaatatgcacgagacgttaaaagttgggtgagcttgcactcaagttcttcaaaaaaataaaaaacttgcactaaagtttgcaagaagttcataaaaagtcttattaatttatttcatacttggttgcttttttgctttgattataatttctaattttttttttttgttttttctttcattttttaaatacttatatgttctttatttttaactaagtgattaaatacaaataattaatgagttgatagtctttgcttgattatatgtgcatcatgttagttaaaatttattaaaaattataaaatcatgaaatagaattattaaataaaatgtgaaactcaaaaaaaatataaattttaataaatttcaaataataaatgataatgtgttaaaaaatgcgtcaaagaatatgttattaccttttctttaaatgaacatacaaacataacaaaactcagatttacctgttgaatgaattgaatataaatacattattttttataaattacttatagatgaacactataaaaataatttaattataaattcacctaattaagttaattgaatcatcgcctacaaatattgttttttttttcttggaaagaggaactgaatgtggaggcccaatcaagtgctcgcctaaaacttcttacatttccactattgtttcatacacttcccattgtactcccattatttttcattttagaatgagttttccataatgtaatggaaagtgcaagaaataataatgggagtgcaggaagcaacagaggcctaggccctgaaaggaagtgaaatgggcaaaagaggcttaggcccattagtgtgtcagtttcccgccacatatatgttgatcttcccgccatctcattcacacacaccaatcacttcgctctcgatttcttcctttcccacttcgtgaacacaattctccaattgattcagttcataatttcggtcgcaaagcaaatgatcccacatcaagaacccgatttcaatctcaatcacctcaaactatattacggttcgtcactttcacttcccgtttcgtctttttcttttaatctctgtaccaaattagcatgattttcattgtttcgtactgggttttaatcttttcaacgttttctcttctcttcttttcgttttctccaggaaagctgtttccttttgctgatttagtcagatgggtgtcttatggcaacggtaataatatcgccaaatccatgcttccaatgggtgttgaatggcgatgcattcttaattttaattttaaggattaaatatatatttagtccttgcaaatagtatgttatttgttttttagtccctctaaaaaatcgtgtcattttagttgtccctttaatgggtgttagggtgttgttttcgttcttcacaaaaattcatctcttttttggtccttggtttatgtaaataggaaccacacgctgatgcattcgtagattatgactgaaaacatatttcactctaattttatttttaatttgtttttatgggggattatttgtagaagggaagcaccctggttgtgatcaatcctacattgggcgaagagagttttccttcactctggagaatgatatatatctgcgcttccaatctttccacaatgcccacgagctcgaaaactccatcaaagaaaaatgccctgttaagatagatattggacctgtctacactgttgatgtaaaatgttcacttttatccaaatcctctctacctagatttcattattatgcttcaagtcttttataattcatgcaaatataatgattaatgcagccagcgattcttttcgtcattaatctgttccttgtatttggttcagcctgcaaaaaggaatgcctatgcacagagtggtgataataatgtctttgccccagttgagagggagttgatttttgatatagtaagattttttgcttgagtctttgagtgaagcctttagctattgtggccttcttcacatttgacacccttttgtattttgggtttctataggatatgtcagattatgatgatgttagatactgctgttcgggtgctgatgtttgtttggtttgctggccgttgatgactatagcgatcaaagtgattgatactgccttaagaggtagtattttgcatcttatatgatattggagaagtggtgcaattttgtcatttatattgttcattacattgaaaaaacaattattgacataataagatagcagtacatctcatataacattgaaagaccatggagttgatgtaagtcacctggcagaatcctcctaaaataacataagtttgcctcacaacacgtatgattctcccaattcataacatagggaaagtgactttactggatttggtcatctctcaccatgatagatttatttttgctgaagcagaaagagacatgatttctacttgaaaatttatgataatagttgtagtctaggctgtatcttgtacgtttcattatttcaacataatttcctgaacattgttattgctgggaaatataaggcttcaacaatgcctaatatacctgttagaggaggctcaatacttaagttagccttcactctgtgatatatgtatggtatggtgttatttgattttaattacacctattactgtattacatgctttgaggttcatcaagcatctcttctgcatttatttccatcccgtttctgatcttttattgtgcttaatctttattcaatgactgagtttttttgtcctaattctttatggcctttgggttgagatgctcttcatatatgaaaatggtcaaaatactatgggagggagggatagaatatgcaacatgcattaaaattatatttaatagctttgtatatggcaagattgagcccatctagtggtgattgcacaaaacaactgggtgttatttgttttgggagagggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggtctgcattttttgtaactgttgtgttgacttttgctcttgggcttctgtttcagatgactttggtttcaaacacattctctgggtatatagtgggcgcagaggtgttcattgttgggtctgtgatggaaaggcaagaaggtgaggcactaaacagtaaacaatcaaaagttatcctttatctacttgtggctgtacagtcataaattaaaataggttgccttcactcatacaggttgacaaatgagcaaagaggtgctattgctgactattttcgtgtctacaaggtatagtatactgatgacaagtgggtttgtcaatacttgtataaactttttgttgatttcatatgctgtccagggcaatgaaaatagtcacaagaaggtttctttgatgggtgctgctcttcatcctttcttggcgtaagtcttaatatgaatcattaactttctgaaccagatctcttatttcatatgctaagcagtattttatttttccaggacatcatacactaatgttctcaaggactattttgagaaaaatctgcttacaggtcaaaatttacttgctaccgaggagagatatgagaagatccttgacatgattcctgatgaatgtactttgttttctgtcctcccttcatataaaccttgctctttcattccctgctattatcttatgcaatacatgagttacttttgcagccattgcttctgaacttaggggaagatggcaagatagtaggcggtcttctagtgcaaaagaagacatcaatgttgttcgatgggaacagtgcaaacagttgcttcaatctggaaaacataaggtattcaagcttctttttaagaaatgtagaacaaggtgacaatgcaggaaatgatgcaggatttgctgaaacatgtatcatttgatattgctatttattattaatgttttctaatcctttttgtaggcacaagggctgcgtcggtgcattgaagagattgtgttctgctttacctatcccaggctagatatggaggttcatcttttagctggcctttttcccatatccactgttatctttcatgctatagaagaccaataacaccttttgactaatttttagtctgaattttgttcattaagactgttcatgttttaggtttctaaacacatgaatcatttgcttaccattctgtgtacatcctaaaacaggttagtatataattatgcacaatttttattgacataaccagttgaattttttatgaggcttgagaattcactggtgacattataatcatatggttttatgattttatctttatatattttttttatttttactatcttccagttaaatttgattgatagatccattagctcatttgactgtttagcattacatggtattgttctttgttctaggccgagtttgtgtccctattgatccaaaacggtgcgaggagtttgatcctactacagtacccaccctttcacaggtatacttattctgcaatgatagttttctgatatgcattccagggagagaaaaactttccaaaagggtgcttagttttcaatagcgatgttttgtatttactacttctgatctggaacttgcattaagacacttgctcccttctccaacacattttcatgtgtgaaaaggaaaacacataaggatgctgctttctgagaatttctggacatctcgtgtttatgtgaatcttgacattgttagttgtatgtaacattgcagctgatagaagagcttaattatgaagtctcaagagctgatgttgatggtggtatgttaattttatactcaatccaattttcctgtttattaaaatcttcacattgccatcaccacgtgtcttggactctggggatcctgtttatgtacattgatatgttccttcaattctaattgcaacttggattccattacaagggaaagtgatttttaatgccttgtttgatagcagaattcaatagaacttcgcttggaaatgctattacacttttcagatcgtcattcttacagcctttactaaaagcctgcaaggtatggatcatttcataaatgttggtaaagtttagtaattttcccttaaacatcattttattgcattaaaaaacttatgcaatgtaaaaaccttgatattggtattatgaatcatttggaaaaatctattccatgtgaaagaagtaatatgagaatgctaggaatgactcattttctgtttctcatttatacgtgtatttttttttctttattacaattcaaattctttaaaacattggtgttgatcttaataatctgataccttattacagattcagtattcaagtattaccttacctatcataagtattttaaataatgaatattgcaggaggagatagaaaattcctataacttaaaattgcagcagtcaaagaattcccttgcttggtagtgccacctattattgattggtcaaatagagctgtcttggggtcacacattagttgacaatcaaatgatgaaatgttcgttgtactgttgaatctttttttgtattttcttgcaactacaaccgttctttctacttctggtgagagaaaggaagttgatttgaatatttccatccactgtataaattttggatgaaacagttaggtgttccgtgttgttccgtgttatctataagaatgtgtttggatagagaattttaattggagaaattaatttatcaaagaatttaaaattctttattttaaaattcattgtttggatgtttttatatgaagaatttaaatttttaaaattttaaaacagaattttaaacaactaaaaatgtgaaattctaattttcttctaaaatatgagaaattgaaattccttcttctataaaagctctcactacaccaatctttgctttgtctccatcgtcggcaagtactctaacttccgttactcccacgataccttcctcatgcgtctctccccgtgaatgaggtttaaaattttaaaatgaagaaattcaatttctttatccaaacacaattttgaaaatgaaaaaattttaattgatatattttaattttcctgaattttaaattctctgaaattttaaaatactccattcaaacatactctaaaggtatttttgccaatgcgtaggaatagtgaggtatcaatttccattgaattcagcagtaattttaatgtaaaggactacaagtttatgcatcatatagttttccgggtattttgaaaatttgaaggactgaaaatattactattgtcacagcacagcacttgcagtaacactccaatttttttttttcgtactttgtctggagttttgttttatagaaaattaggtaaatgaccatgctaggtcttattgtggtttccattaataaccgatgtagttacttaattcccactattcttaaactagtccactagatcgtttttgacattgcgtggcaactaaggaaaaatgtgtttcttggtgtgctgttactaacacgtaagctggtaaagtctctcacgagtcaagattatatagtaaaaattgttattatgtggctgtgaagcaagttatatgaaaatacaggaatagcaaacaaaacaaaccacaacatgacattttatgaagtccaaaatccaattggatagcaaccacactgcgagcagccctatcagttgggtaggtccaaccgacagagaaaaggtctcacatcttcgctggtgttcatatggcaaccgtatattctcgttgcccctcgatggaggctaggaatatactcctattaacccttcatcctaactcaaattcttaagtatggttaggatgattttttttggcattgtctgttttagtgttcagtgatccatcactattttatttttagtgaattatgagagaagactatttataaacttttcttggcttcaatttttaagccatatgaaactttttacatgtaatccacgaagctgtgtacttatatacgactctacatgtattgcttccactaaattagtaaattagacgccaaaacgtagggaaaggtcaaatatgtaaatatgcagccctgtgctcaagacaacaatccgtacattacgcccaagggttaattttttttcggctgcttatgattattgtgtcaactcaatcattcatgctaaaatcttttttttttttaataaagatgggcttgaatactgagtcagtcagaaacaagtaattccaactaacttggtatcattaattaggatagaaagaaaatacaaatcaaagaaatatcattaaaaaaaaagatatacaaaaagtcatgggggacaataatcaaacctcgtgaaaattcaacttatctgttaaaagaatttataattagaaagacttatcttatttatattgtattctgatatcacaaaaggaagaaatcaatcccaccaatagaaaaaattaacgcaggagaggtaagaaaatttgtataaatatcgtcttttatgtaaatatgacctatttgaaagttcacgctcaaaattaaggtttttcttattccaaaaaataaaataaaaattaggtttctgttttttttttttctcctcgaaagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataataattatttatattctacttagtgtttatagttattaaactttttaaaaaaaaacaaatatacactttcaaaaactatattatattaacaatttaattaggaaaatgctagcagacacaaaaactggttaagaaaacaaaatagaaaactattaaaattatacaaaaaaaaaagatcctttctgtttcagataattcttgattttagtaaataaaaaagaacaaatagtaaccaataatcttaaaatattattaaaaattatttaaaaatgtgttgttaatacacccttaacataatttcgaatatattcttaacatgattttaaatgaaaagtttttattattaatttcttacttaatattttaatggcactagtcagaagctctagtaaaaagaaaaaacaacaatacgaaaccgtgttggttcatgagtccagatagcgtagcgtgaacgtgaaacacgcgttgcacgtgctatgttgcgtaagcatgctcatgctgctccccactttaatactgctataatttacagcaaattaaagtatgtagatattgaattaaagtttgagcaaatcaataatgtattccacatttccgctactaaatgctactccttatcacatcaaggataaaagtatgtaatgttttatttttaataactctcaatgatataactaaaattatgtttgcttggagtataattttcgtataaaatactaaaaaaatgtcaatgaaatggtttcaggtgttagtataatttttaagataattattataaataattattgtgacaaataatataaacctataatatatcatgatttatgtttaaatgataatataattttttttacatataaatcatttactctttaaaattttcaattaaaactaattaaaaattggagtgagatgatgcagaccatattggaacacctacacatactccccaacttctgagtcaccaatccttaaaatggacgatgcccgcaaggccacaacgttcatgacattaatgaggatcgatacgacatctcaccattttgatatttttttgtattttttttactttgctatatagtacattttttatagccacagtatatttttttacatattattaaattttttttttagtactatcatttaaatatataattttgaacttttttttcttcatttctatgatatatgattgttaattgtttcatcacagaatatcattcttgcgtttgtattattaatgtcttattagaagaaaaagacatatttataaaatggtatattttcatttcaaagatatcactgtgtttgtactattaatgttttattacaagaaaaagacgtgtttaaatggtatattttcatttcaaatatttccttttcaacatgaagtgatattttacacagaaattcatcatatattttacactttgaataatggccgttcagaaaattgaatagcgacgaattttttagtatatgttaaatccttggtcaattttgaaacattaattgaaagcataatgcacaatttttcgcttccatttacggtatctaaacaaactacattttcagaataatgctcagttctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgaatatctcacttatacgacttaataattttatgaaaaatacaaaattaaataatctaatcattatattaatttttataaaatatattaaaggataaatattcatttcatccttaaatatgtagagagttgacaaatttgtctctaaaagatgaaaatttaaatttttgtccataaaattaaaaatgtgtgacaaatttatccctctgttaactttcctccgttaccgttaattgaaaaagtctaagtgacacattcaaggataaatttgtcaactttttacactttcagggatgaatttgtcagctctcgacccaaaatataatttaatcttcatatttttccttttttaatcattacaagcataaaattataataaacacttaaaaaatagaaaaataaatataagttaaaacaaacataataataaacataatattgattaataaacataatttgtttttttttctgaaatttctattgtaacaatattaagtaatgacaaaatcaagttctgaaattaatgacataacgattgtgcattttttgtttgagtatcatattttgggtaaggtactctcacaatagaaatttcaaagcaaaaatatgagacaataccttacccaaaatatgagagtcaaacaaattaaaatgcacagtcattaaattaatccttacaataaaaaaatgagatacaacttgattttgtcattatctaatgttgttacaatataaattttagaataacaaaaaaattatgcttattaattaatattatacttattattatttttgttttaacttatgtttgttattctaatttttaagtgtttattataattttatatttgtaatgattaaaaaagggagaatatgaaattaaattatatcttgaatagagagctgagtaatggacagaagttaatgaattgataaatttgtcatatttttttctgtttcagggacaaaaattgaattttcatcttttagaaataaatttgtcagcgctccacacatttaaggacaaaaataactatttatcttatattaaatttataaaaaaaaatcatgttaattagaaactagatgataattcatcgtaataattaaaacaagtgatggtaaatgttatagaatttttaaaaaatgctatattgaaaatttgaaatttaaaaaaatatcggagtaagctgaaaggttaaacctgacacgtgtttggcacattccctgtgccatgtaagttggagaggggacagacaggtaattccacaacagtaactgccaccttacttcgtcacctgtctttcggaacctgaaatcacgaaaccaccctccacactttctcaaaataccaaatacgccccttcggtataataagaatcccaaatccgtacctcacaagcgaacgcgaagcagagagagagagagagagagagagagagagagagagaagagagagagagaagagccgccctttcttacaataaacaacaactcattctttcaaggcttcaacaacagaaactttcatagtttttcactccttctccctgtgtcggtgtgctcttcttctggggcattcgttttttgcttcttcagctccaacttcaaacgtgcttttggtggaagaagcttcactgggatcactatggtgggtgtgtgagagagggattacggattagtgagtttttgtcactaagagctatgtcatttcatgatcgaggggtggtagcagtttggtgttgggattgaaggtggggctttatttggattctgtgtttgttgaaggagctggggtaggtggggcaaatgtgcttgagtttttttttatgccaaaattgaagcttacctttctatgaatttcttctgtttcgtattggtggcttaatttggagtagctgttgcctcagaatgcagcaagatcaaagaaaaaaggtgaatttgttgtttgttttcctcatttccaagcatgactctaattaattgctatacaaatcattactttttcaagtttttctctgtcccgaatgaattatgaaggtgccctttttgggactaagctgagtttaaccgaatgaattataaaaataaaatcttgtcttgtttagtgttggtgggttactacttgctaccgagaattttagattacataagtcaaagtgtgggagtgaggttctgttaagttggttccatggggctgtgttatgatgttagttagctctctctcaatgtttaatccatcacgtgacataatttatttcccccacgtgacatttggttgacaagatctttatttttttcaccatttttttgggggggtataatgtgttgatgaaatttgcataacgcttctttgaactgggtagatggcattcctagggttgatcttccatcccaatcaacccacccttttgcttttctttgtttctacgtattctgagatgtgtcttgcacgctttaggtgcgttttacgagattgactctccgaaataaacgttggtgaatgacaagaagtgatgatttggcgaagaaaaaaaatattcgtcttaaaatgaatattggtttgtcataagaattgtgatgtgttgagtggttttaagtgctgtattttccccttcttttgggctttgttaagctggggagtgaagcgttgtatggtgacaatgtgtttctttatgtttattatttgttatttttcttgtgttagtccaatctatgcagacatgatcagattactgcaaatataatttctactctctttctttgagtctatgattcttcaatactgagtttcataatgtaaattctattgcacacacaaattttgtgttgtgtgtattaagcttatggatggatcatggattccgagatataaattaattttccttgtaacatagcaaagaaaaattatttattactttaatttctatttatcactttaatttctatttatcaattatgaaaatttgtttcccaattggtgctttagcttgatttattatttgtagacaatcaaatttgggcttgcctgattttcctttgcggattactttaatatctttggtacagggctcaatggagatggaatttttctccgactatggcaatgtcagcaggtacaaaattcaagaggtcattggaaaaggaagctatggtgttgtttgttcagctatcgacactcatactggcgaaaaagtagcaattaaaaagattcatgatatctttgagcatgtatctgatgctgcacgtattctgcgtgagataaagttgcttagacttcttcgacatcctgatattgttgaaattaagcatgttatgctgcctccttctaggagggactttaaagatatttatgttgtttttgagctcatggagtctgatctgcatcaagtcattaaagccaatgatgacctaacaaaagagcactatcaattttttctttaccagttacttcgagcattgaagtatattcactccggtattcttcaatatttgatagtttacttgttcatgaatatcttctttgaatgcgcattgtgttgctagtggctatagcttgttttctctctacaatgacatgtaattgaaattgtgtcattccttagcatttttcttacaaggatgtctggatcatctatatttttttctctaactattgctgttgttgacttttttttgcacctcattcctggatctccttaaacttgtatagttcttttatggttttgccaaaatgttttacttattcatttgtcctttttatattttactttgtctatttatcaacataaggttgctggcatcaatgtcaatattgctcaccaattacatttcaacacattgcagcaaatgtctatcatcgagacttgaagccaaagaatatactggccaatgcaaactgtaaacttaaaatatgtgattttgggttagctagagttgctttcaatgacacaccaacaactgtgttttggacggtattccatcccaacattttctctgtttgtttcataccttttcaacagctttgctagattttttgctccctcatatcaaaagtattggtaacataggggctgatgttttcttgcatacttaatacttttctataggattatgttgctacaaggtggtatagagcaccagaactctgtggatcattttactcaagggtatggccttttcaagattttcagatatcatataagtggtagagaacctaattatgcataatcttgactcacaccatacctaattcatgctcattagttttgtgtgtagaaattgtatatcaacccatgatacatgctttctgttatcttctttcccatcaatagctaaaagtaagacccaagaccaatctgttatttattcttaatccactggttttctgtttctattagttttattttgtgtctgctgatgagctaacggtaaggtattgactgcagtatactccagcaattgacatttggagtataggttgcatctttgctgaagtattaataggaaagcctcttttccctggaaaacatgttgtccatcagttggatctgatgacagatttgcttggcactccctcgctggatactatatccaaggtagtttctttttttctctatagagggaaaactgtttgtattttcttaactaagttttactaacatcattgtttggctggtttacaattttgaatctttgtgttggatgcaggtacgcaatgataaggcacggagatacctaactagtatgaggaaaaagcagcctataccatttgcacaaaaatttcctaatgcagaccctttagcactacgactactggaaaggttgctcgcctttgatccaaaagaccggcctactgctgaagaggtttttatattgttctctatttcttatgtatgtgtgtgtgttgaaaaattattctactcagataattaactgcttcttgagcttatgctttttctttggagtttggacaatagaaatgtataattgatgtgcaacaatatgtgacttccttgctttagaattctgaaggatttgacattttcaggcattagctgatccttacttcaagggactttcaaagattgagagggaaccgtcctgccagcctattacaaaaatggagtttgaattcgaaaggagaagagtcacaaaggaagaaattggagagttaattttccgtgagattctagagtaccatcctcaactattgaaagactacataagtggaacagagagaactaattttctttacccaaggtttttatttttggtttatcgatttatacttcaactgtttatcttcttttccttaatattttttattcatatgttctaccctattattctctccttacccttcattggtgcatattcttcacagtgctgttgatcagttcaaacagcagtttgctcatctcgaggaaaatagtggtaaaagttgtcctattatgccacttgaaagaaagcatgtatcacttcccaggtaattcactaatgtagtatctcattggtttcacttgtcattggttgtaatcataggttgttaacaataggttactttgattatattatatttaagatatctattcattagatataactggttttttaaaacaataaccggttatatcaaatcataacaggttgtacaaaattggttttggttatggttatgataacaacttgtaatctggttatttagtagttatggttgtggttacttgaataaccaaatcatgaacaacactaggcataactcaatcccacaaaactcacttgtaaggtgaggattatccaaacttcataacctattttaacatcatatctctagtcgatactaaatacaccccctcaaagctgcaattaatgcagcccaaagaggttgcaactaaggcacagctcagagaagccgcaattaaggcaggtcaaggatgaccgcaattaaggtgactttccaacagtttttacatagcataatacagtatcaaagtggtgtttacaccttgtagtcaaatgttgagatcttacatcgactagagacgtggatgtgaagtctaagggttgcatatacccttcacttcaaacccgctgttgatatttatttgagccatggtttatattgctgctaattactttctatgtgccctttttcttaattcatacctcctgctaacccgagcgagcattcaaatatttgtcctacagtcattagggaaggtacccctagtggattgaagaccatatcaacgtgtcttccatcttgcaaataaggcatatcctgtctagacaaattttttgaaacgataccttcatttccatgtcccccagccacttaatctcctactttaatttcacgtttctgtaaaatatatatacgaatcccaccatcctatttatctgctctttgaatgtctcagcatggcatgagatcaaatcgaccaaaataatccacatcttctccaggctgcatttgctgttacaactgtttcattcatagggagcctaatcagattacatcatactgaactttttgtttgtttgctttcctcttttttggaatcattgacaggtcaacaattgtacattcaaatatagtaccctcgaaagagcaatcaaacattacttcctgcataaaccagcaaacaactgaggaaaataataataattccagggatacagaaagtcctgcgccaaggtctattcagggtctgcaaaaatttccacaaggtatgtgactgttatcaattatcatcatgcctttgttaagtttgtatgcattattagtaatgaataagctaacattcttgtgttcagcaaaacctggaaaagttgttgggccagtgattccatacgaatatgcaagtgttgtcaagggtacatatgatccaaggacatttatgagaggttctgttcttccttctcaacctatgccccctacgaatcattatcaaagatcaacctctggaaaacaagaaaggtcagcaacagaagctgacaaggtgcctttacaatccaaacttgctcagcaatgtggtgtgaatgccaaaatagcaccagacatagctataaatattgacaccaacccttttttcatgacacgagcaggagtgaacaagatagagcaggatgaccgaatagccattgaaacgaagttgctgcagtcaaaggctcatcaatatggtgggattagtaccactgctcatagaaaggttggacctgttcagtatggcatgacaaggttgttctagaagaatgttgtattgtgaatagtttggccagttggagcaatacttgtggagaataagaaaaggttcttcatagtggagaagcagtagtctctggtggtgctttgtgtaagacgatgatgatgacaggagttagtgcttccccagaaagagccagctttctctggtcaaaccttgtaaacattggtttcagttatcaataaattgtacaaccgaatttgagtcctatcttgtaattcaatccacacattcctttgctcaggatatatatttttttaaaatttcctgcaataactattttccaagtagaaataaataaatcagaccggtacatgtactgctatacgagtaaaaatgtggaaaatgtaaagtgttttatgcgtgttatacacaccggacgcaaaggagtttcattgtttaaccatagtgttttaaccccctttggccatcatagaaacagattcctcacaagtttctttaacaactggattccatttaaaattatatcaaatggttcaaatgctaccaaattttcctcacctaggcacagtaacaatttatccttgaaagtaggtttggtgcttgcataatttccttctatttatgttttttttttttattttgaaagaagaaaaatagacacctcattgttttattggaatcaaaccccaaacaaatagtttgagcattggatcgaatacgacgtcacagtatttcatatgattttgaaaatttgaacggacatgtgcccaccttctcccctcatggagccacattggccttccatgtggaggaggttactgcagctaccttttggaagctctatctaatagctagctatacaggataagattaactttatgtggagacttgctttcagaatgtacaaccacttgtaagttgtaactcttggatttttctacttcttacttccgaatagttaaaatgctaatggtggaatgtgtgatgcaaagagacttgtttaggttgttactaatctatcagaaaacctggtgaaacagtcttgtcagaataatgttgcattgcaatttgcagcccacataatagaatcgaagataataaaaaaaaggaggaaaaaaagagccactagatgcttggctctaaaatgtactgtaacattgttgatttacattaatcattaatttaatgtcatacattaaaaacataaaaaagaatgacctagaaaatgaggtaaatccgaaattgagataatgcatttgaatgatctggtcgcttgtttattgtttggcatttactgcatatgtaagctgcagacaacgcggggctcaccaataaaagtctgagtcagttcatgtgctgatcattaagttgttattatcaggttgagaaaaatcctcattcctccctctctacaagaccaactgtgaatattcctcaccagctgcatgcatttatttttccttttcctttttctaaacctaattgctgatattgttgcaataagttttgctccagtgattttttttttttttccatttacctacgcttcctaaaaatggatgctaaaacttccctttccttgtttgaacctttgtggtgccatcatgcatgcctagttcatttatattcatagaattttctttaattaaagatgattaattcaatgtttggttatcatcattcacaatatgattaaataagtcaaatgttatcaacatgggttaggtctatagagaaggattagtatcttataatgtgacgaatcaaagtttaagttttcaatgtttactatctgaccacgattctttaagtaagatcgtttctaacaaaaataaatgtgattagaaaaaagttaagtgttagttaatattcatgattaaacatgttaaacatttattatgtgtattcttttatgttttatatatctatgtcctcgtgacctactaggaggggaaataatggaaacatgccattaggtatccctagaggcctaccatgtgagagcttcatttgtttgcaccgtaagatgattttggagatgttaataagtccaaaggatgaatagataaaggaaaaaggtctgttaaaaaattgtgaacagaaacaaaactcaggtaggatgtggacacacttgcagttagattagatgtatgacattgaattataatagctctctcatcaatgatatatgtgccaagcaaagcaaggcccctatgtagcaaattgatttcaattttcgtacaagaaatggtggtacggaccccattaccctccagaacaaaattaaaaaaaaaggaaaaagagttatgaaggattgaaaaaaagggtagtgtagtgtgtgaatgtgacaaaaacagagggatccgagtgggtctgagcacatggagtcccatatgcccaacacaaccaaatctctcatacaatcccaatgacccaatccgccgattggtttccttcttggaaacaccaccacctcccctctctcaactcactatgatgtaatgcatcaatcttcttttcactctcttatgagtatcatcacacttacaacaccatctagtttctcaattttttaatctaccatttttatcttataatgttgtgtataatttattcttaccagtatttcttaatgaattgaatgcttatataatgatattataaaataattttataatttcatataatgatacattattatttaaattactttaacataattattttaaaagttgataaatttattatatattataaattatgattgaattattgtgtgtatatttttacattttcaatgtataaccgtttacctgtttcttaattatataaattaaatacaaataataaacggctataaaaaaattgtattctttctctctctctctctctctcattttggtgaaaaatagttagtataatttactttcttacaaatatctcaagctttcatcatcgttcacttttttcgtccttttatttatgttttctttatcttttactcacgatcaataatttttgtttttaagaacatattctttaacacacatctttaaacacatcctctttaattaatataaaattattaaaaactataaaattagaaaaataataattaaatgtagtatgagactcacaaaatctaaatatttttaattaattttaactaattaaaaaaaaagtgttcaaaagaatgtaataaagaacgtctttctattatttatctctctctctctctctctctctttttttacatagtgactcgatttttgtttttgtgtgttctgttaaatttatcatctgtgcaacattttttttattgaaaaccattcaaggcagttgatacctttcatttcagattattgatttttttttacaggcatttattattatggatacgacataataaatcatttaataaacatattgtagtcatgtttcttctgttttctctttaattaagggagtggcgtatttttatacgaaaatgccacttaaatgcgaacttaacttgtttatccagaaaaccaacttgtcctaaataagctaagcaaggagtatttgatttccttaaaatgccaagttgttagtttaatagggttgggattgatatgattctagcaatttacatgattaatttggcctaaaagggttagaagggggggttttgtggggctcaaggtggggtcattggaaagtaaacacgtggcagtcatgcgaaggatcgtgatggagatcacatggcatatgaatgaaagagaagagagtggagaggcacatgggtgggtgttaagttcaaggaattcatgtgagcacatgtgctttctcccctttgttttgtgtcctgtgggaccattttttatgctctcaccccttaacggggttgcatttgcattttgcagtcacttgtaaactttatactttcacctttactctccaaaatcctcttttgaatcttactagttaagaatccttaaaatctaatgcccatacatattttatagactattaacaagatgcatgtgtttagcatgctataattgatcataaatatccctttagtgcatctaagatgccactttcctatgatcttgcaacaccctctaaaagctatggaaatagtaattgtttgattccttaaaaaaaaattagtttaacatatttttattaataattattagaatactatgatatttttattccaacctccaaggaaggaaataataagcaatgaaaaagtaacgtaatactttaatttcattataaattttttattctataaccttattaaaaacatttttaatataacttctaaaataattattataaagataaaatttagatacaaatctataagtgttatttgctttttttataatcaaaattaaagtttcacttctataattcttgtaacaaaggattatgcattagataaaatttagatgcgggttcttttaagtttttctttcggtaatacaaagtaatatttaataaaattctttattatgcacattatcgaaattaaactctaagttgataaaaaaaaaacaacatcaacagtatttatgatattgcatttagattttgtttattatgaagacaaaatcattataaattttgaatttattataaaaataaacaaatttatcatataaaactattagtgacaagataagaaagtagaaaaataacttcacaaagataaacaaatttagaagggggagggtaaaaaaattgatgaggggtgttgatgtggagcgtgaaggccacctcatcgctccaatccaaaacttggggggcttcttcttcttcttctttgtgttgtgaggccaaaaccagtgggaccagcttcgttggcattgacatttctagagctcaacaataatttaacatcttcctccttccctccctccttcgcacacaagacaatcacacctcatataactccctcacacattaatctcccttctctctctctctctctctctctctctcacacacacacacacacacacacacacacacacacacacacaccaaattagtactataactacatgtcatcaccatcatccatggaacaagaagataacactatcatacccacattcctcagaaaacctgcagaagaccagaacaacgacaactctcccaccccttctcacaagtctttgcatgttttccgccgcagcaggaggcggtggaggaaggaagtggcagtgaaagatgctgtgaaagaagaagatgaagaaaaagaagaaggagaagatgagggtgatgaaagagaagatatagagaggaagattcatgcattacagaggattgtgcctggtggtgagtctttaggtgtggacaagctctttgatgaaactgctggctatattcttgctttgcagtaccaagtcaaagccttgagggctctcactggtttctttgagaagttggagaaggagaagacaaagtttggaggttgatggtgaacatcaacatgagatgatgaatgaatgaatgaataatccatggtgatgatgatggattatggaagcaagcagcttaggttaggtccttttggtttttcccacagaccccattagttagaaattttttttttcttcttttaatttttatgttttgctttgatgtacttttggaagttgggatcaaggaaaatgtttatcccatgatcgatgttcttagatttttaattttttaatttttttttaatttttaattttgaagttctcatcagttctttctttctttttcacagtgttattttttttccatgactttatctatatatcttcttgaaagttgatatattcatacgccgcagattaatgttacagaaggagttattgactttaggcaactgttgtaggaatcttattaacctgtttcatgatctggagtggagtaaagttagagtagatgcaagtgtatgacacattatggtgtggcttcgatgtacgtgggctgtgacagggttcatttttagttcatcttggtccagtgggccacccctattgggtcttgaaatctggatgagatcagacgttttataaagtaacatggcacatacacatgttgtcattggtcactttctctcttattttgttgtgaaaactttgctttggagattttggaatagggttgtttgacttttttggcagttagccattactaccacgataacttagacttagaatgcggtatacagaaagaaaaaagacagcacctctcccacttgaagggttgtaaatttcacatggcttctttctcatccgaggataacatgatcttccataatttaaggtaaaaaggaatacattggcgatgatagtgttagccgaatcattgtacagccattaatttgttggagatgcatcactcttaaccttcttgattcttaccctgtgcatgtatttcaaagatggaacatagcttacaaataacaacaagagtcactaactttaatatgtttgcctgcatttttagtggtaggaaaagcagctcactttctttcaaagttaacaatcactgcttaaaaaagaaaaaaatgtattcaatcagtaaaattgatacaacacaaaaagttgtttcctttaattttagaatatattgtacatatatagtatcatatataatgtcaaattttctatgtttaaatacattaattttattaaaaatgaaagaaatgcatgtaaaaaattgtgggcataataataaatactatctttagtcttattcatacaaaataagtgattatataaaatatattatcacttattttttataaataggactaaaggtataatgagataaaatcaaggttgttatgagcaatgtaattactattacaccgatgaaatgaccatttaaaggtcattttttagttaattattatttagagattcgttttgaattattatcaaaaaagaaataagtcataatatatgttatgacttttgaattaaaaattgtaatcgatattattgtttctacttaaaaaaaatacgactttaaaattataggaataattttttttaagtcgtaacgacttcaataatatcaaatgtgactttgagttcaaaagtcatgttacaacttattttggagaaatttacaaaggcactcccactacagtcactattttggagatccaacagaacaccacactctggcaatcaaattccagcatgcttttgctgaaacaacccatctgcattctccaattgaaaacttcctggaacagtcacagtcacaatcacagccccagccaccacaaattttttgagacccagaaattaacttgggcgtgtgacattgtgaatgtgaacaacaacaatatgtatccatcatagcacataaagcatgcatgcagcatcaacattcaacattgacaacatgtatgagttatctaacttctaggtggctgactattactgatctacataaccaccaaatttatctccaaagagtgcatatatatatatatataataaccaccaccagtattgtaacgccacattcactgatgaaacaacattataatgctcatgtacaattcaaaggaattgccaggcaggggagaaatttacacacatctcttcttatatgatgttagtgccacttcatctacagaatagacttctgataccaaaatcatgttaacggtaatttttaattaaataataatataaaactattttatattatcaatatatcaattactaacatgttcttatgtaattttgtatttaaaaattaaattattataaaatataataaacttaagcattaattatttatgctttaaatacaaacagtactcctgttgaatgtatagaaaaattatcaggtacaaaataataattaaaagagaaacattaattttttaaaaatcaagtgatatatcattttaacaaaaatgatggagaatgaggttaaaaaacaagacaaataatttttgttttggttactaaggagggctgaagcccccattttttttaataaaaaatcttacgtgataggttgcaataaatataaaaccattccttggatgcactcaatatatgttggataacctggagtggatactcgagacctcttgggctggggatgaaatagtcgcagaagtagaggaataagtccaatttatatttactattttatattagaattagttttcttatatggcataaatatttataaattcaaataaaatacaagtaaaacctaaaaaatatttaaaatgatataaataatatttattaaaattaaaaaattaactaaaaaatttccatttattagcacacaaaaatttcaaacgttagaattactcctgtatatagttattattgtctttttttattttaaatttcgtaatatagttgttctcgaacaaaaatttaaccgtttgaacaaatattgcaagtctatattaatatatagtaagatgtattaaaaagaaaatactacaagaaaataagaaaagatcacacaaattgatttatcgtagttacctcatacttacacctataatcttgttacatgatctctagacaaaacttaaactctcccttcaaatgtttgtggccctttctccacttagagtggtgtctcagctccctcttaaggtttagtggatttttttatctcaataactcctattagatatgagaaaattttcttctcttaaatagttaatttctttagaattttttttactctcatgtcttaatgtgactctatagtatattgattgatatagttcttagtgatttttattattgtattttgaaatagaattctatagttcttagtattgagtataactatcatttactactttggtcccgttgaaataatttgtcaaactctgtcattgatcacatttcttctcttctcgccaccaccttcacctaacctttctcccattctttttctagccatcactttcatctcctttattttttactttatgtgtttctctatgtaaccttctctttgactctatttttcccccatcacatttcttcctttcaactgaacttgttactaccatcttttgcaattgtatccaaactaaagttacttaggcaacacttccctactcaaatttgttgttttttttatgaggtcttctacagaacactactttactcaggttagttatgacttattttgggccaactcagtttgaattgttgttggacaagtgtcgttatataagaaataacaaaacaaaagaaataagagtagaaaatcttagactctattaaggtttgtttgtaatgggaggatgtgattatcatgcatgttttgttgtgttcatagtttgctaatatgtttatctatttagctttgagcgtgtttgatttgctaacgtatatttgttgtacacttctttagcatcctatatatactcttgtaagtgtctttggacattttcaactaatgatcatttggaaaaaaaaagaaaaagcagtggctattgtgagttgcatgtcatttgtccctttctaagctaacctttcacaagtatttgcacttaaaagagggttcaaggtgctaatcttgttacaaatattagttgagaggtattggcaaaggaatgcaaatttcaatctctaaattgatacaattaatctacccaaatgattttaggcatgctttaccttcttaccttatgggtggtgattgttatcgtattatgtttaagaaacatgtgtggttgattgcccaagttattaacaatctctatcgagttaagtttgcatatattgcatgattgataattgttactttgttttgtatgtctatttatatcatgatattttaaaatgtgagatattgtgtatgctattagtataataatatatgaagtaaataataatttgatttctccctctttatatatatatatatatataattatatgattttcttttaatgagctttcccttgtatgttttctttttgtttgaatgttttaacgagcttaatcttgtattctttaaagatatactattatgtagaaatcaaattgaggtcattctctacaatctcaaggtccacccattataagttgtttttagttttatttatttattattgattattgattgatacatgacatatataaacaaatggtgtaacattcttatgctaaatatctctgtgttggaatttggaagtgttttcaattccgaacataaaaaatgaaaatggaattacccgatcgaatttgacatgctggcgcacacatcacggagaacataatttcaaatctgaaccgtcggttgattctgatcgcactttctgagcacttccttttgtgaaggaaaaggtgaaaacgaaaatggtaaagttttaaagatatttttgacgcacactacaccactcaaaaccctagtgacacccatttcataaaacgaagctcttccttcctttgtcactttcccggaaaatcctccccatttttcctggaaaatttatcttccgttttctctctgacaccaccgcacactcttcacaccttctctcactctgtactgtccttaccttactcttgctctttgcttcataagaatgtacctcaacaattatttattcattttttttttttgtttacttccgtgtataatttgattcacggaccgttaatcagctacttcgagcttataattacaatccattttcattttttgtttattttattttccgcggtgcaattcgatttcgatttctggcttaattaaccgctttcagtgtttgcgttttttcgttgtttggcagaatcaaccatggcggacgaaggtgttgccaatggcggcggcgtcgacgatcagtacggcgaggaatcggcgactaagatcgtggcgttgcaacgcgagtgcgacgaattggtgagcgaaaacgtggcgaggaaagaggagatcaagaagctgacggcggagctcgacggattgaggagcgacggtgcagataaaagcgagaagatcgaagagctgcagagagaagtggcacagtcgcgtgatgctgcgaaagcaacggaggttatcgccgcgagggcggcggacctggagacggaggtggcgaggctgcaccacgatatggtatcagaaatgactgcggcggaggaggcgagggcggatgccgccgaattgaggaaggttttgggggagaaagagtctagggttgagtctctggaaaaggaattggcaggattgaagaaggtgaaggctgagagtgaggttagggttagggatttggagaggaaaattggagttttggagactaaggaaattgaggaaaggaacaagaggattaggtttgaggaggagaccagggataagattgatgaaaaggagagggaaattaagggttacagacagaaggttgaggaattggagaaggttactgcagagaaaaaaactgaattggatgagtcggttaagcataaattgaggttggaggaggcacttagagaatctgaggagaaagtgactggtctggaattgagtattcttcaattgcgcaaggaagcaaaggaagctgagagggtgatcatatcgctgaatgagaaggcggtggagaccgttgagtcaatcgatagaggtttaaacagtgtacacggtgaagggaagggattgaagttgcagtggccagtggtggcagcagggtctacaggagctattgttgcagctgctgctgtaatctacgtgtgctatggaaaacggagctgattttctgtctcatcggagagtgatcaaggagcgaggggaatttgaactggaggaggttctagaggttagacttaccaggtctttagtagtcatagatatgctgctgcaattttgtttgttacaaaataatgcttcttctctggcttttgtttctgaagcctgttgattttttgctcatgtcgaagttggcatactacttttttggttgttagttgcttattatgaggatcaaaccattgtgtgttggatttaataaataggttgcaaaattgagattacttgtttctttgtgtttagtttgacccttgttagcttggaggataaacaatggcactgctgttagtttaaggcggcacttggtatcacctcttgtcaagctattctgtttctaaagttggtttctgcatccatgttctttttcacagcatggctttgaatatagaacccacctggtgaattaattgatgtttcaggattagatgatatcactgatttattgttgttgttgttattgactttttgtcttgcaatgtggtcagagagagatgatttttcgggtcttgttatttttttcttcccatgcttatatcccatttgtcgtaattgtattcagaagaatttgtatttggttgaatgtttttttcagttgtagttgtaggtggtgggtttggagtttgaaagcgttggcttgcattgcatccctttctttccaccttttaatagtttctgttaagttgactagtactattaaccttttgctttaatttaaagagacacaagggtctatttcgtgaatttgtagatcaattgtcaaacaagtagtgtcgactgctgtgctaacgtttggatagttactattactaagctattgctgacataacttgatagatactaagctattgtttaactgcttaggaggcgaaatttcgtgaagctgtagcatttttgttggaatttttctttcgtttcttcagtgaggcacaaagaattttttgtggttttccaacttcaatttttattatcatcgaatccacttaatgcgttaatgttgtttatacgcgaagaaagtctgtttatataaaatccccttaatctttaatttgattctgatgtgtaaaaatctctactattgtacaatattggaaggacccggcgtgagctgcaaccctttatgattccctgccctataaaaatgaacaccaaattcaacaaaatgatttattatcggttagaaaaatggttcctgctttaaagagcttacgttttatcttgtttaaaattaaaggtgaaggctcaatcaagtaataactggcttaaactttttttggtactacataataacttgcttaaatataaaatgaaattgatttttttcaaggcgaactaaaaagtcaatttcccaaaagaataaaaaagaaaaattagccactgtaagttgcatgatattcaggtagaaatagcttttaccgagcacacatgtagtatggcatctatttttgtagggtcattactcattaccagtgtcacttttgtaaaatcagagtgcatcagctttcatttaaaaataaattatccttaattttcagctttggatttgtaagactgtgtggtaagcaaaaagcgttgtagctacgcggtgtcagcctttaatttttgggcccaacacctggtaaggatagatcttatcaggaagagaacctttcacttgcacttcgtttagatggctgacaatagggaagaaaataaagagagaaacaagataaaattttcaattttgttgtttattcgagaggagaaatagatagatgtttctaagcatttcacacactaaaaacttatagtgtttaagcatataatttaacagctaattttactactaatttttaattcaataatagcataacaatcagttaaaagtttctagctataaaaattaatttttcaacatctaactaattaactatttgaccaaatttaatagtaaagtttgttacaacttcaaagctattacagtatgggctatgttccatttctaaagctatgatcaaactttataggttatattttcgttgtgtatctagttgagatacataacggaaatatgcttccattacatatgccattaaaaaaaaaaaaacttaccccaaagctcgagtgagatgcgatgactgaagaggaaagggataggaagtggggaatggagaagaaggacaagtgtgacagaattgtgcaagagcaaaagagtttgagaaggagaggaatgaggtgttgggaagtaggggaaagaagtttaaaagagtttaggttatggagggattaaagagaataaaacatgagaacgtaaaaaagtcatgaataacgtaattatatgtattttaataaaatttttaaatttttttaaccaatatcctaaaatactattagtgtttataaaaaaggagttaagaataacaatttctataagtatttgtgtttcttagatagtcatgctccaaacattcccttcctctctcaaccatcattaatggaatgtgctgatcgtcaaccaaacatgggacagcttaaatcatcctttgaatgtatcatttcaaagcaatggccctttttctttggtttttgtagttcatttgtttagcccttggcctttatgataaaagacatttattttttttgataaactatgataaaaggcatttctatctctatacagaagaagaatgaaatgacacatgagcttacttcgtatagatcataataacgtggtgattgtaaaataacttttgataataaattctagttcatggaagtttacaatatgccacaactaaaatgtaccataccatacattttgtcatttttgaaatgaaacaatgtaaccaatctgattctgaaacgaagcaggaaagcaaaccagaacatgccccttaatttgaggctcaatgaatgcacgcaggacagattttgtctgaaagggcaccctcacagcctatgattgtgcaatgcctcagtaaccttagctcaaggttcaaccttctacgatgctctgccctataatattgaaaaatcaaataacgattcacaacttagaaaattgccccaaagcaaagctaattaattttgacagatgatcagatacttaaatttgactattgacaatcttcaggtcaagaagatcgaatcagttttactacaagtgttttcttaaagacaaatgctaaagtactgtattaaggacatttgttaagaaatttaaaataaaaatacttttattaaaaatgaaaaattatgttatttatatttttttttatgtttttctattatttatataataaatactttcttattttaatttttaaccaatattttaatagatcctttcttaaaatatcatctcagtatttagaaatttgacatgacttgggcttttgactcttgaggagcatcagtgattataacgcatatatcaatatcccttgaaataattgttgaaatcaataaaccacattagtacgttgctgccaaattgcacctaaagtactattgaatttgtctgtggtcactaaagatttcagaaccgaagtcttggccaaatatgtttaattactacgtagtatcggtataaaattattaattaatcataaattattattaatgtaatattttaaaaaattattataaaattaataaattattatatatgatattttgtaattgaataatagtataaaattattttagagtttccaccctcaatgcattcagtcaaaagtataagtgataaccaccaatgtaaccatattgacctaaaatgcatgctagattgtattcatcaccattcatcagtaagcatgataaaatttcaggcaaatattttcaattcttttcttgtttagaggaggtactttcattactaatatgtgtaggtaattgatacacagttggactcgtacttctgttcaacactgacaattgaggctgcttcgcatcaagtttttatttgcataacagcttatcattctccttgcaatgtccaaataatttgaaaagccactaattaacgtcatattttgaagctaaggtaatcaaaacaattttctgatacttaaatcgaagcaattttaatccttgttttaccgacagtttcaaagggagttgtaaagttttgtttgagaaagcacaacagctctaaagcgttgttatttccatatcatacttttttttttcaaacttaacaagacaaaaagcaataaaaagattctgatgccaactagagtattctctttagtggattacgcaaagtcttaaaataaggaaaatgtataatttgtttgccgagggtctccaagtcaaaccgtgaaatatttccattaggtttatatgttattatagtgacacttaatactacttcagacccaattaatatcctatcataattaagctatataccatttaggtatacaatttaattaaattctcattcaagaagttgtacaaagaaaataagtcactttcatgagctgaattaagtttcatattagccctttcaaatatttgattaatcagttatttatcatttattattggtcaaagaaagaataatccttggttgaggtttactcaccttgaattatctatcaccaccactcataatctcaaagagtccgcagcaactcttccaagaggtgttttccctttgagccacaggaacaattgtctgtcacaacaaaaagagtatgatcactacatccataaatgcatataaaattacaaagacaaaccttacaaccaacacttgcttagcacaaactgaaatgtctataggaaattatcataaagtttgaatcacccaccggattttcagtgctttcagcatcaggaacacttggtgatggttgaaaagactccttggcactttcataggatgactcttcttggccacctgatggttcctcaattttctcatccaatgttggctcaaaatccaatgatttctcaattatggttggagcaacctggtcactctcatctgattttagaacacttgtctccacagtttcctctgaagtcacatcagttagaggcaaagaagaatcaccatagacttcatttggttcctcactctctctaagcaacttatctgtcacaactgaagacaaaacattcttctcctctccaccaaacatcatgtgcttaaatgtttcaaccacaacttcagtttctttctgtccctcatttcctgaaactgaaaagagctcattatttctctctgaagaaggcaaatccgtttccttcacctcatcattaaccacagctagatcagatagaaaatctttcccttcctcttccttcaattccaactctactgcatctgattccattgtattctcaacttgaccatctttcacagcatcaggctcaaaagtctcacaaactgattcagaaacatcttcttgtgtcacttcaactttgcctgagtcaaccagctccttattctcctcatttggtggtgcctcttcatcagtgatggaaatatcaccatcttgggaatcatcaacttcaacaaccacctccttatcttctctcaaagtttgtgtttctactttgtggctgtcttgtaatgttccattgagagatccttccattttcttgcagtggtttgctgaaacagctgcccctgcaggtaaaaagaacgacgctatattattctcttcaactaccacaaaataacaaacataatagccttggcaaatgggtgccaaactgccaatgaaccttattctaaaccagttttgtgttaatagttattgaatgaaaaacaggaaaattaacaaaaataagattaaggaaagtaacaataagaaacataggatacccaacaaggatgtacaaagaacagatggacataaagaaaaagaggacacgcaacaaaatgtaggtggccggggaaggtagatagagagtgtagtaaagagtgattaccttggagttgatcagagtgagaagaatggtggttgagaatggtcacagttttgtgtttattggcttgttttggtttccttcttgaagctggaggcatggacgctgactggttgttccagagaatggtggatgaagattggtgttggtgtcaatgccaatggttatagacttatagcagtgtgtgtgtcagtatgtgacttccctttctttctctttctgcttcttctgtttacttatataaagaataagtgcttttaaattgaattgaaacgctcatggagggaactcaagtgatgatgaaacgttaaaaacagttccatctcaacttgaagtatattctgagtgtgcgtgtaacgatgtgtactatgtttggagtacaattttcatctaaagtaaaattccttcaagttgttttaaataaggtgatatatggattgttttgttaccttaaaattttaatttttaagagagtattagtacttttgtgtaccaataaaaaaataattatttatatattaaaatcacatcagaaattaattagcatttaatttcaatggtgttttaaattttataactacacatttttcaaaattttcaaaatattaaatatgaaaaatgtactagtgtaaatggaatgggcaacaaagtaattcaaggcccgtttaacaattacaaaatatcaagatactaaacaataagtcataatatcaattccatattacctataggtaaaagttacaagtacaaattaatgtctattatttattggtctattcaaggtatcaatatcctttaatatatgtaaacaccataaaattttccttaattttgttgttgtgattttccaaaatttattagatgggttaatttgttgtcttcggagtgaaacgttgcaaataaaaaatgcattgaaaatacgtgagaggttttaaaatcagcaaaaagaagctgtaatttataaagggttttttaagcaacaagcataaaaacaatcttattaaaatgtactaatcatataaagattttagtacttgtaacaacaatataattttttgtatattatctgcaattatgaaatgtcatgtataaaaaaactctagggcaagtggctaatagtaagtatctttttactattatattattagagttttatcaaaaagccgctctctatgggcacataaattggttgaaagatttgaaagagaacgttattttaggaggaatgatacctgttggtgatataaaatatatatagattttgtgagtaaataatcttggtcaaaaaatttgattaatcttcttgagtaagatatttttctctaaccacaagactaataagtgtataatctaaatatgcacactctataactacaaacaacgctcattttaatagtttttaaattctatttatctccttatcctgttagatatacatttacttctttatcttttaagctgtcaaatatggacaattgttcaatctaacaaaagaagtcgaagactgggatagaaggaccatgcggaattggtggtctttatgggccgatggttagcacctcctgtcggtgcttttcatcccattttaaaaaatgtttgataaaaatccataatgctatcttacacttagatgcagagttgaaaaagaaaaaaaaagttataaatataatagaatttatgacatgatagaaaaaaatgaaaaatattggtgaaatatttaaaatggattatgtatgtgtatcattattctatctattgaaggatattcaaagctaatcttctatttttttatagttgaggtgaacaaatataaacatcttctaactctatcgaaattgatttttttttttaagtgggtattacctcttatatgcactcaaaacgatcattgacatgcgtaattaaggttaattacataaaccatattaaaaatgtatttaactttttaacaggagatgtcaacggttgattgagaaaaactacatatttctggatttaatagaatgaaatattttcactgaacatttatacttttctaaaataataaattaaattcttcagtgtacattataatcatgcatgcatggtttgcccatgaacataatgatcaagcaatcctttaatgggaagtcacaagtgtttattctttcggcaatcatgtggaaaaccatgagcaaaacgtatgaaatcgcggcaatagtcgtaaacaacccatcttgaatggatctctttgaggtgcttcctgatttgagcatcaagacctttgtttcttccaccattgaaacccatgcaagatggggtccctggtccagcaatgcacgcattcgcattgaaatttctgaaacctgctataaatggagctttagaccaatcaatcttaaccttcccccctcttgttgcccaaaagtctccattccataaagttgcataaatcttcattggttgacttgtggggaatggaacaccgatgctctccctgttgtgcatcactctgatgggtgtgttatccaccaagattctacaaacacacataaaagaaaaacacatttattctatattgtacccataagtagaattatacaaatttattttgttccttacattattgaatgagttgtaatttcacaagcaatctaaaaggtttttttaactgtcattcaagtataaacattatgataaatttcttaacttttataataattatcaagtaatattaacaatgatttcttattgattgatagaataattttttttgttttacatatacaacatgtatctccagaaaaattattaagtatgtggttctagatcattatgttttcaattaatttttacattatatgtatattaagtgttataaattaaataacttaaatacatgttacatataaagattggcaccataaacaggtctgctaataattttttgcatcttgaaatttaattagttctatgattaggccatattaatgaattggacgtctatgtataaaaaaaagctttataacgatgagtgcatataaattaaattcttaattttatacataaatatattttgtacttacattatgcgctgactgttccaatcaatggaataggtgtggaagtcctgtgtaggatcaaaccaaagatagaactgcatctcacgacccccagtaccgttggcataataattggttgagagaatgtatggatcaccagataagttgcccaagaactctaaatcaatctcatcatggtttggcccttgagagcttagctgcagaagtaatatgcatgaatattatgcaatatataatgtagtatatgtgtatgttgtaatatgtttacgtgtgtgtgcatgcatggatgggagagaataagcaagtgaatgatgggttaacttggaacaagttagtcatacataaaatgtagtgacagtgcctgcagaatttcctggtataagcttgatttgcatgtcaaatcgtccaaacaagtactccttcttggttgctatgcccgagccagaagatttgtccattgcaagggacatgcttgagcctccatcttgtatgttagctcgattatctccaaagagaatgttaaaatcagtgttgaaattcccacccaaagcaattgttgttgaggctaagaagctgagagaaagcatgaataaaacatatgaagaagccatgttaatttgattatctgaaaaaatatgaatccactaaggtatttaaagtgatgttgcattcacgaattgagatgataatcgtaaaatgcagcggattcatatcaatttagctgtcaaaggtggttgtggtaactgcctcaagcgcaatattgctgtcacaattacaggtcaaaatcttgaagaaccgaataaaatgttttttaatcacaaaattaaagttctgatgggaggagagttggttttgatgcatagatatgtgtggacacaattttaagttgaacacaagtcaaagcccaaaataagttaacactaaaatatgtagtctatatatgggctggaccatgaagaacaaaacaaaaataattttcaatggcaaaaagggggtttaacttcctacacccaacaaatttctaatacacccagcaatttttagaaaatggcaatactacccttgttgctttttaacatacacccagcaggttttttcttcattttcttcttccatgctccttctgcttcttcgcgtcttcactgttggttgttggctgcgtgttggtgcctcttgtgtggttggtttggttcgggaggtcgtggttagcattggtggagcttccattggccgctgccgtcgtcggaggtacgttctgcaactgatcactgtagcagaaaccatacggattgccaatccgtatgggttttttttctgtttgttttgattttgggtttttttttggttattttgagttgtttttgttaaaaggaattagtaattattgtatttttcctctttgaattaaaataaccattaacttttgaattatgaggaaaatttgttttgaattaatcacaaagttgtgaaatgaatataaccatattttttgttaatgattatttgttttgaatttgtttgtttattaagatggataacgatgattggatgcatgatgatattatggcggaagaaaataatatgggtgaagacaacagaggtgaaccgtttgcatttgagaatgagaactctatgattgattgttctgatgcatttaagacttcaaaggtatttatgtgataaagtagcatattgaatgtcagtaaataaataatttcatgagattgaacatgtattctgaaatgttgtaggtgtttaattctcgtgacgaggtattgcaatgggctcgtagtgttgcacatgagattggttttgtagctgtgataatgaggtctgacacagcaactggtaagaggggaaggaccacatttattttgataggttgtgaaaggagtggaaagtatagagcattcaacaaagatttagaacgcatgaccagtagcagtagaaaatgcgggtgtccttttaagttgcgagggaaacccgtcgtaggtggtgaagggtggatggtaaagttaatctgcgggttacacaaccattgtttggctaagtcattcactggacatccatatgctggtcgtttaactgaggaagagaaggtaattgttggtgatatgacaaagtcaagggttaaacacaaaaatattatgctcactttaaaagatcgcaatcctaaaagttatacaacaatgaaacaagtgtacaatgcaagatatgcataccgcacttgtataagaggcaacaatactgaaatgcaacatttaatgaagcttcttcatcgtgatatgtatgtccactggcatagactgaaggaagaaaatgttgtccgagacatgttttgggcacatccggatgcagtcaagttgataaattcatgtcatttggttttcctaattgatagtacatacaaaacaaataggtatagactccctttggttgacatagtcggagtgacacctaccgggatgactttttcagctgcctttgcatatttggagggcgaacgtacgaacaatcttgtatgggctcttgaacgatttagagggctttttttgaagactgaatttttgcctaatgtcattgtgacagacagagatacagccctcatgaatgcgatcaaagatgttttccctggcacaatgaacttgttgtgtcggttccacattgacaagaatgtcaaggcaaaatgtaaaacgctcgtgggacaaaacaattcatgggagtttgtcatggaagtatggggaagtctggtagattgtgcttttgaaaatgaatgggatgagtgtctgatgaggtttgaatgtgtttgtgtaccatggccaatatttgttcaatatgtgaaagacacgtggttgatccctcacaaagaacgatttgtcatagcctggactaataaagtgatgcatcttggccacaccactacgaacaggtaaatgctgcacaatagaaagtttacaattacattatactgcatggtcatcatttagttaaccggtgttattttaaccgtttagtacagggttgagtctgcccattggaccttaaagagactactgcaggacagtcttggagatttgtgtaacgtatgggatgcgatgaacaacatgatcacgttacaacacaatgagattaaggcttcttttgagacaagcacacatgttgttggacatatgtttaaaaccacgttatacaaaagactcgtaggcatggtttccaggtatgcgttaaatgaaattgccgcagagtttgaccgagttaagcatgtaggtgtagatagttctcgttgtggatatgtgttaagaagtacacatggtttgccttgtgcatgtgagttagcaaagtataatcttggcagcataccactgggcacggtacacatgttttggcggagattgcatatgtcggactcaggtgttgatgagatggaggtgaccatcacagaagagatggaagcgatatcgaagcgatttgaaagtcttgacttgtgtggcaaagttactcttaagactaaattgaaagaaattgcgtatcctgatcaaacatcaatgtgtcctcctcctgaaaaggtcaagacaaaaggggctcaaaagaaaaaccttaccaagcatcaaagatcaacaaagcgagatccatcgtactttgagtacgtcgacgcattacattctcaacatgatagttgctcctctgtaccacaacccgcttcaacatcttcaggtcctttaccgatgggtgatattccaatgctggatcagttccttccgtgcatgagaaattacattattggtgtatgtgatgttaaagccgatggtaattgtggatatcgggttattgcggctctactgggttatggtgaagatgggtggcctgtggttcgtaaccatttgcttaaggaacttaacgaacggtctgcagactatattctattgtttggtgggttacaaagatttgaggacttaaaaagatcactacttgtggacggattctcaatggtaaatgtgacttgtgtctgtgattgacaatattaccatattgttatggtgcataacacttatactttgttaaaatgcaggtaacacaggataaatggatggatgttacagacatgggttatgtaattgcttcacgttataaccgggttcttgtttgtctttctaagcaacaaagtatgacttttttcccgcttagaagccaactgcctagagatcctgcgatacatcgagtcatttgtatcggtcatgtatatggaaaccattttgttcaggtacaactaatgtcgttttatgtgtttctaatcatttgacttgtgtacattaacaataaaacggtttgtgttcaggttgcattgcgagatggctgtcctatgccaccaattgcattattatggtcaagacattgtcagcctcaagcaaatgagtggccatctagttacattagtcgactgaagaagtatacaagcttgacaacattgccaccagtttatgttgatctgggttctgacatgctttgactttacgtaatgttttcatgtgttgtgaactaaatggcagggggttatgtaattgtattaactgctgcattctgttatttcgcatgacaaaatactgtcgcagatggataatgttaaaaaacatttacatatatgaaatgaaatgtttgaacaatacaataatgttaatacatatgttgtcaacaatacaaaaaaagtaacaaatcaatctccacgcggtccagtcctacgacgtctcaagcgaacatacactctccgatcatcgcagacactgcgtgctaatgtaacacagtcggcaacagtctcgtacacatcggtgccagaggtcaccaaccgaagatctataagcctctgcaacctccctgcaatggttttgaatgcggcctgcaataaaaattagacaaactgtgtaagcggtcgttataatcataacacaggttaaacattttttaatacgagacatgttttacaaatttgtgttaccattgcatgccgaggcatgtcaggctgatcagctgcaatgtcacccgtggggtctgccgtagtagatggtggatcatctgtggtaactggcacatgaggaggcgctctgtcttccccaggcttaggcgggcacatgaaagggtgtgatatccggtagaaccagtccatgtatgcagcctcgcactggccggggtaaccggaagggggtcctgtgatagtaagatggtgggcgtaatgaagccagctgtcatccacctcttcatctgatggggtgggcaagctcaggagaatggggatggtctgaatgcagccaaactgtctgagtaccctctctggaaggtacctaaatataacctgagtagagacagatgacctcaaagggacggaccggacgatgatcgatgtatggagtccaacagacagcgtcggtcgtcaacctatctagtcgcctccgataggaactgacaggtaacgccttccccggcttccagcgacatgcccgtggctggctctctacatagtcctcatccgcaatcatgctgccaacacttggaaagtactcgtatacccaacacttaagtaacaaaaacaatcaaacacaaataagcagttgaaattcactttcacattaaacaaataacaaattttaacttatataaaaaaattttacctgaagcagactaatataaccagcaagatgtttaccatgatgctgacaggcgtagttcaagttatcgtacatgtgttggagtgcagtcgcccccaactgaacccgcctgactggtggagatcacgaaatggctccaagaataccacaccaatatgtgtggcactcttgttagcaaaaatcgtgcaaccaaccaagtggagcaaataagctctggctgccaccgtccactgcatctggtgacacctctcatcatataactcccgcaaccatgacagacgaacataaggtccatggcactgtttcgtctctgctgcagcctggtcatgggtaacctcaagcaaatctactagtaacgcaatcgcctcatccacgtccaacacatcgtacgtctgcagcgcacccatcactggtagatgaaatagacacgcgacgtcgtccagcgtgatcgtcatctctccgatcggcaaatgaaaactgctagtctccttatgccacctctccaccaatgccgagattaaaccccggtcacctgtatctaccgaacaggtgatcagtgggcttaatcctgtacctgccaccaacccttcaatctcaggcgcaggccggccaaatttatgcaccttcctcccatgagatgccaacttaagctccgaccgttcctgtattagttgttagttacatacacataccctaacgcgaaaataattatcaaattcaactatgtttaaatacaatcatacctcccccctccaaatcctaggtgcaatatgttcatcgtaatgactcaacactgaagtgtcctgcggcccaccggaaaatccgtcaacatcagaggcatcgatgcttccctcgacctcagcctcaacaggtgcaccatggtcaacatcgtcagcgtctacctcagcaggcacgtcctcaacaacaccagtcctttggcgttgtctccgtgctgatgctgtcggtcttcgtcgtacagcgggttcttcttcactagcatttcttgccaaagcccgccgtaatcctatcgtcttagccataatctgacattgaaaccaagtagttacattacaatcatacccatttggataaacataatcctttcagataacgaaacctaacaagtagattaaaaaccaactaccagctccatacgattagacaacatgcacttcacatgtggatcaaatcatagtaagcatgtcgaggatcaaaaccaatgtaacaagtccataccattacacaacatggttttcacataacaattcatttaaagagttcattttactcataatattacacattatctagccatcgatcaaaccatacacatgtcgaggatcaaaaccaatgtagcaagtccataccattacacaacatgattttcacagttcaatttattaaaacagttcaatttcctcatcacatttcaaataacctaataaatgtggatcaaaccatagtatgcatgtccaggatcaaaaccaatgtagcaagtccataccattacattattaaaacagtacaatttcctcatcacatttcaaataacctaataaatgtggatcaaaccatagtatgcatgtccaggatcaaaaccaatgtagcaagtccataccattacacaacatggttttcacagttcaatttattaaaacagtacaatttgctcatcacatttcaaataacctaacaaatgtggatcaaaccatagtatgcatgtcgagatcaaaaccaatgtagcatgtccataccattagacaacaagcttttcacataacaattcatttaaagagttcattttactcataatattacacattatctaatagtcgatcaaaccatcaaaccatacacatgtcgaggataaaaaataatctaacaagtccataccattacacaacatactttacgaatcattcaaccataccaattccataccaaacacattttaaagcagttaatttcattcatttttaaaaaaattttaagcaaatactcctacggattggcaatccgtgaggctcccacggattggtgatccgtaaagctcccatttttgcaatttcttaatacggatccttaatccttattaaatacaccttacggatttcaaatccgtacgcatgccaaacgaaatgcacttacctcatcgccggaaaactccaccaccttcgtcgcctaccaccacaagccgtcgtccagagcccgagacaggagaaccacctgaaccaaaatcgccacaagcacacacagagcacagacaaaaacgcggaaacgattcgaatgctgggtgtattagaatttcaaaaaaagcctttcttttattattttaagcaaggtatttggggtaattccaaaatagctgctgggtgtattagaaatttgttgggtgtaggaagttaaccctgcaaaaaggtctgattggaggaagttggttttgatggcaatttttatttttgggctttacatggctgcgtcttgacaaaattacataaatcaaaatcaaaagcccaaaagaagttaatactaaaaaatgtagtatggactggaccttcattacacccttcgaaacatgcaacggaatagattaaaattaaactattaagttgtaatattaaaagttgaaatcttaaaaaatatcattataaagagactttttattttattccccattaaatacatcttccacggaagacaattatgtttgaacaagtagaattattatgctcgagtcaaataatattattatagatataaaaattctactttcaattatttaacacaattatatatttaagatctgaacttgagatctataattaaactaaatttttttaggtaagttgatccacatgtttgatgatgaaaaaaattaattaattaaatattagaaaaatgatttaaaaaaatagtatttaatacaattacatattcaagatctaaacttaagatatatgattaaactgaattttcttaaatcagttaatccacatatttgatgatgaaaaaaattaattaattaaacactaggaaaatgatttaaagaaaaaaataatactagtcaactagtatgaaaattgcggaaaagtattgagtatggtacacgcaaacaaaactacgttagtacgtggtgctggcggctgagtgtgcgctaaatttagcgccccttggctcgatgacttgaaggtaggaaaatcaaatttgtacgctatttttttattttattttgtattttatctgtattactttttttttttttactttataaagaaaaaacctctgcttaagagtttctgcatgtgcagcaagatggtcacacacactcacaccaaaggctctctcttggtatagaagttgaacaaaattctagaaattggagtaatagaatgtaaataattgacggtgcaaatatatatcacgatcaagtagttattgtgcagtgctagctgtcaaatagtgatgatggtggtgagctaggtgcccccagtgggtggcaattcagacagaccatcttaacttcttcacgttcacaacagagcactctgccacatatcagtgccgtgcaatgcatatagtcaaaactgtatcagaaaactcgtgtagctaagtcttcctccccagacccacacaagtagtaatatcagttggtacatttccgatccatatatttacatctgtgtagtattacttgaccctggatctcctccagcaaacaaaaagtacgtttcttctaaaattgatgtttgaagggttatatatattccaaaatggtaagtcatgagattaattcttaagacataaagattattgaaataaattatgtttctcccataaaagtctttttcataagtaaggtagaataagaacaatataataattctttcaggcatattctataaaatagtcataattcctttggtcacgtgtagtatagtttatttggattttttgaagtgttaaccggattcaagacttcttaatagtgagtatatatgttttcaatctcgagcttgaccatgttgtggatcatcaaatgtatgtgtctttcaagcttaacttcaagggattgtgaagtgttcgatcgtgaatcatacagcttaataagcatatgtgcttttaagacgattgagtgattctcaattgtccaattgaagatggatggacatctaatccttggacccaatataatggcaagagtcaacacaaaatacaccctataaataggcatggctcgtatttgatcatatgagataacgcatagtagagctcatttgaatttcttgagttattaattggatttacgactggggcaaaaaaaattaatattttgttttttaaaaaaaaaaattacttcaaagttatttacgcatctataacaacgagttgcgccctcatcggatgcgacttccctagttgtgacacgtgtcattttgaaacatatggtattttgaggcgcaatgtatataaacttcaaatgattataatttttgatagaaatgtccgattgagacgtaatttgtgtcaaaatgctcaaaattgagataggaatggctcggaagatccatggtcaaccttttttttttcatcaaaaaatgtctttaagtgcctcaaatttaggatttaggattcaatcatccaaaaatttcctttttgtctacttttttaattatttaattagttaatttaatgctattttctattttttaattacttctcttatttcgagcgttttgacataaagtacatctccatcggacattcctataaaaaattatgaccgttcgaagtttgtatatacaaaaatagttagaccatttgaagtacgatattcaaaaatagcattagtacgatttttttccccaatagggacatatttttctttatttaccaaatgggggcagggtagtcaacaaaaaaattaccacgtggcacaagtccttttttttttggaaaaaatattggtcactaaaatttaatcgctaattttggtctctatttcagtcgctaaaagtgttagcgaccgaaataacgacggaatgagtcacacctggtggagggcacgacttgacccctgttgcacctggtggggcacgactcgttgctatagatgcgtaaataactttgaaattacagtaaatctgtaatttttttaaaaaaagcaatattttaattttcccccccaatgagtatgttatcataaagttgtgttaacaacatttatatcagaatctgaaacttttcaaagaaatgagtacaagcacattttattttttatctaaagataggaagctaaataaaaatagggtcaattctttaaatttttttttacataaattatttatacttttaatttatataaagtttctcccattataaaatatatttttttatatttttatttttattttttcattatttatgttattctaatataaaaaaaaatcaattaaaaatttaataatgtttacttttaatagtttcaaatagtgctaccttataaatagaagattttatgtaattagtcaaaatatgtaagaagggtgttcttgttatttaaaaataaaggttttaaatttatgtgtatcatattccttgggtcatgttattttctccttctctgctgatataggattttgttttgttgtcatggatgaattgtgggccaactaaattggtgtgcagattgtttggaggagaaggaaatcaagtggctgattgtttagctaagcttggtttgtccttagataaacagctatgaatttttgaaattattcctctatttttatcaactgtagttttgacagatgtatcctctaccacgttttcttgtgatttttaatggattgttcttaggggtctccccttccattcaccaaaaaaaaaaaatggagagaatttgtgtaggttttaattacatagaaaaaatgtctaaaaaatgtaaaatagaaaggaagttcgaacagtttacgtaaaaaataatataatatttttatatgtaaaataaaaatataaaagtattttcttaaaccaaacaattcgttaaaaaggtttaattttaagcttttttgctttggttctcagtgattaggtgatcacaaatgatatgcctgatatgtttgttctatcatactttgacctccagtgcatccgttttctcttctcagtggtgttttgatatttaatacttgatgatggtgacaggtgaggaagctagagacttcatttctaaatagtaaacgtgttatcttttgaaatacaccattatatatgttcatgtttggtatgcattcatactatatgtgaaagaccatgtgagtttgtctattataaataccgtcctagcttgtaacgtataacgtagtatatatcatatagtaatgattaatgaatgaacgtgcccacttcattaatttccatcttcatccttgtttaattaaacatcagacggttctaaaagattaagaatttgataaattaaaagaagcataacaaatcacgtctttcatcagttactacttttcgcaattatttcatgtcagccatttactttggaaatgctgaaatgtacgtaacaccaatatcttttctggagttgtgatcttcaatggatttgtttcccaaacattctttttaactagtatattccaaagatgctgttcatgtgcatcttttataatatgttctgaatttccttcgaaatctagtcgaaaactggatccatacccaagtaaataacatgtgcaaacgcctcaattcaaggacagcatacgataggaaacaaaataatattaattattgtcttattggtaatgtgtgttccaagagtacaatatttttatatgtaaaacaaattcattttgaggttgtatgatcatgtatacttgggagaaattctaatgggcattccaagggaagggaaaggcaaaggatccattgcgactggctcatctgggtggagtaagaaccactcatattgggtcacaacatagtgcacaaatatgaggatatttaacttagctagtaggtaccctgcacacactcttggccctcctccaaagggaacaaatgcatattggggtattccgatccctcctcaaacctacttgggttgaaactcataggatccttaaaatactcttcattgtaatgtgtcccgtatgttatccatagcacctgagaagagccacaagaaaccccatgttacatgatttaattcaaaattgacaaattatgagatatgcatgcatggatttaagaaggaaacaagaaagtagtattcaccttccatcctctaggtataatgaatccttcatattcaatatcagtaatagccttcctgaaagaaccaaagattggaggaaacaatctcatgctttctctagcaacttgccaggtatacttcatcttctttatgtcctccattgtgagattctcaacccatcttttgttgctcattatagcaacatgttctgcataaagtaagtacttcaaactatcaactatcaactctaaatacttttggataatttaaagaggaaatagtctatacacttacattatgaaaagttttagaatatcaattaattataatttgatatatatggtaagcttttttttagaatatcaatcggtgccctatctttcggcatgatagagtcccttcccatgagcttaactgaggaagaaggccaagagattttcaccaacttgaactcattagacaacaagaatttattggcctcagctccattcacaaccacagttggagaccccatgctccttgttctgaaaatcttctcatgcttcagaatgcgaggatgaacaaactcttcaaacaattggtttctcctttgagcattgaagaattccatggtctcccctatcaatggaaaccccatttcccctggggggagctttcttttgtctttgtagcattgcttatgtctcaagaaattgaaagagactagcaaaagtagtaggggaaacaaaccccacaaaataaaatagataatatccccaaatattggtgaacttgtaaggatcaaggacttggaaaaatttaagctcatatctataaattgttttaagattgaaatgttggttcagcacatttttataggaacctgtggtttgtggaagaagatgaatgaagtcaaacccaaatgaattttacgattattataatcttgatcatcctagaagtcaattccttcctaataaatttctaatttgtgacagaaacaaaaaaaagaagaaaaaataatactgtagcaccacagcttgtgaaaagaatactgaaggattcttttctgtaatagattcattgtccgaaaagaatgacacgtaatcatcattaatatacctgagaaattcatgatgcaaaataaaaataatttttctcttcatggtcaacgctagaagctttttagttacccaagaatccttaaaaatctggtgaagtctcgttgttttatcatgtgactttggatcatgtttcagtcatcatgattgctcattattgcagcaatgtaaatactgattggtgtctgatggcgcagaatcaccgtctctgaatctcaactttaaaatatcttcttaaagtaattacaaaggtaggctgataatgttggagataatgttgtttgtaaccgcctaagcacagtcgttgaacattctaaacaaagttttcggagcatggcgataaattaaatcagcatcgtttacatgcatgttagaaagcaggattttgtgaatttattgcttgttgggggatgtttagcatagaaggttcatcatttcatatgtcaaaggaactctataaacaagctgtgaatgaattgtatacagttgcttttttacaagaaatattatgattacaaaaataacaagatttgtatttgctcaatgtcaccaaattttgactcgttgttagattattaccatatcaatcatcgggccaagattaacaaattggttacaccttttgattaggtgtttaagaggtatggattgtctaactgagattaataaattgcctgtctttcatgtttagcatacgagggattgtaaattgtttaaccaaaattaacatttgtctatgccttttagatttagcgcttgagagattgtgtattcttcagccgagactcaggccacacatggccaattgactaagcattcaacatgcctttaaacagattaataagataaatcaggctttcaaagggcaaaaaaataaacctataataaataatatactaggcttaggctttggatcttttaaacagatcaaatctatccaccatcaataattgacacaagtggtggtaatagtttacgttaatcaaattatttagggatcaaattccaatattagatatgaaatacaccatgctggaaagagaatatctatgttacgtgtgcttagtccccaacaaaatttagtcactattttttatagtggatattttgtttcaataccatggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaagccttgttcaccctaacctatttctactctaacaatgatcaaccacgacttttttgagagaattacctctattattattccatatgatttcactaaacattagtataattttgctgtagttaaaatagaagtaaacctggcttttgtcgtggaaccttgcctatgctggctccatagcaactacattcataaaccaaatttcactctttaacaactcgcctattttggtaagtaaataaaagaaacttattaacaacgctatggtccttccaatctggtataataagctcgtcgattctatcacagccatatggtaaccaccgaaacatattgccaactattgagactgaggacttcgaaggaagcaacaacttttatgtcaggagggaagcttcctatagacataattgttagcatgtgatagactcagagacgttagacggttgcattcaatacagccaagacttaattatcaaaacttatgcagattagacgatcgaaagcattatcttttgaacaataaaaaaaatacgaaaagaaaaaatgtgataaggtagttaatgtgaagaaaaaagatagagaaaatagtgtttacttccaatccttaggtgaaatattcaaggtataatttgaattcttcaatggtcttttacgaattaaactctagggtaattacttgtaagactctaccagagtactactactatccaagacaatgtatgtcgtagatggtgaagtaaattagaatttgagtgtgaatattttgggcttacacttatatggctctcttcaagctaggacgataattctcatgcaagataatgtgacgaacgcttcatcccacaattcgagggtgttcattgctaacagttttatgtcatatgtctcagcatttcacgttcgtatgagctcttgactcttgtgtagcattaggaagtggtgaggaacattaaacattgttgagtagtgatgaattgtacttctatagtttttgggtcaacatgtctacctaatcaaatagaccaagatgggtcgagaacagtccagatcaaataatattataacaaatattctaaatacaatgttacagtataaaataacattactttttttgtgcacatgtaaatttattattataaacataatttaataatgattattccgttaataattaacataatggatacctatggccttgttatttattagtcatcttccagcttcacttcaccccgagatttgcccaacacctgtaaccaatatttcaggaattattaattgtttagaagggtggtccttcaccaatgtaaaatgagttatttctgataaatttatgcaaaaaacagaaaacacctttcttctacatttttttggacttgaatccactagtatgttggatttaaatttagttaaatattttgcttgatatgtttcataattagcatataaaataatactattaattaattaaaatgtagataatgaatttgaaaacgagtgtctacctatacataaagtataagaataatgaatactagcattgctacctatataaaaatgaattggagatgaataattttctaaaatacagatatatgaacatattttatatataaccgtaatcaataattagatataagtgattaatatgctgaaattaaggttaattcatttgggtaatatccgaattggatcattcataaaaacaattattaatcaaattttgtttaccttccaattgaacttcaaattagtcaagattctttctttctccttggtaaatcaaagtgttaagaaaaaaaaatatcaccatacaaatgaaaagcattctctcctgaaattcatatagaaaggtttatgtgtcatgaatatttatttatttcaaacagagaaggtgctccttccaaagtccaaaatgtatgtttaccaaggcagtaggcacacaaaatctaaattgaaactccagcaaatgaaaaggtgttgaaacctatgaaacactaactcggacatggagatagatataacacggacacattaaaatctaaaacataggatatgggtacacaatattaagtgtctattgatttttaaatttttttgattaaaaataaaattagagaagtatatgtgatttgtccagattagtatttggtaagtggtaactaaattaacaaatctaacacgatataaaactatcaatattagatcccgagaaaacgttgtcctcaactggttcacccaatgcatagctcaagggccagttagtgtacgctcctctgtttatggccggaatttttttattatgtatttggcaattttttagttttttttaaactttacatataaaatcaattttaaatataaatgtcataaagttgtaggacaacgtgatactaaaccctaagaaacatgaaaagagaaaaatctaaatccttatttatgtcctattgatgaagaacaatatacaaatccaagctttaacgatgaactcagaaatgtccctcccgaagcacctgcccaaaacagtcacaatccatgaaaagttcacaactccattgatgagagactttccagttcctacttccaaaaccatgggtaacaatagcaattcacttccttacaaacaaatagacaacagctttgtcttttctatttagtccataggccacagctcacaggctcacagccaacttgtttttctccagtcctatacattacagtctgcacacacatttatgtatttatatcaacaaatatttaaggatatgtttggataaatttttctattaacatttatagtaaaaaaatgtaaaatgtattatttaaacttctctataaattaaaattaatttatacacctttattttttattttatttttctcttttgagggtgaaaaactagatgttattcggtagtagaaactgaatgatttgtgtatgtttagattaaaatttgaaaaattaagtttggattaaactttagtttacaaaagtatctcaaatattattttttttacaactgagtttcaagacaaaattttagtctcaaatatatttttggagattaactaaacataattttaaactcattttcctcttaaacatacttttaaccctcccaccggaaatccaaacacacccagccttagcctttgtagacacaaaatgttccacttggaagggaatttcatctatccagtatttctcatgcaaatcaaaagctaaagatgctaattcatggcaactctagctaaacaatctgttataattccatgaaaggagttgctataaatacttctaaaaaatttagtaaacagagtatacgtaaacaaatttgtaatatacaaattcaaaatcgatgctcgagtagtatcaaaatgtgaggacagcttgtaatcttaccggcaaaaaaaatggggggaaacaccactcgtatccactattctcccaacatttttttagtaaactcacctaccctctgccattgtcatttagttcggaatgactcacacttgtaatcttcgacattagggtcccttctctctctctctctctctctcttcaactgccttagttcaatatattttttcatgcaaaatgattattacataaatattgaaaaattattcctggggcacgtctccattagcccaataaatgaatcgggtgctggagatttctctgtcaagtagtatttgatttgatttattgaaggttaaataaatgtataactcactaagcttacagaatataaactggtttacgcctgtaattaataccataataagacaaatgcaacactcaaagctaatgagtaatttcagtacaatccagctcaagcttatgattaacaagaaacaaaggccagagttaggagagtgcgttctgtgttttaaagctattttagaaaactcaggcattattgcatgaagtagtagtaaatacggagtaaatgctcctgcaaaacatcaactaacccgcatactcctccacctgctaatatttactccactctgtgaatcattttatatattcttcccagtccactcccctctccaaactcaaacccccccttctcttctttctcatagtgttctaagcagtcagtgacaatggagaggaaaagacacagtcctatttctttcactatgttcacattgctacttggagtgctttctcagaaccttgtcatccctgtagtatctacccctgccatcattgtggaccagaagaactacaactctccagacccacatgcaggaacagatttatcaaattctctatgtaattctcttactcaactatacattttgcttcattatttatgcaaagtagaagatatcatttccttgctagctacagtaggccatttactttcaaatttgaagtacgaaggatcaatagctcttaaagaaactatcttgacatttaacttaaaatctaatagtatacgttgcttttacttcttgaaggttcatactgctctccagatcatggttctgggagtggtgggcacggaagctcaccacaccactctcatcatggaacaccctctcatcatggatctccatcacatggaggtggtggaagttacaatccaaccccatcaactcccccaggtggtggaagctatgatccaactccatcaccaccctcaagtggtggtggaagttacaatccaaccccatcaactcccccaggtggtggaagctatgatccaactccatcaccaccctcaagtggtggtggaagttacaatccaacnnnnnnnnnnaccactctcatcatggaacaccctctcatcatggatctccatcacatggaggtggtggaagttacaatccaaccccatcaactcccccaggtggtggaagctatgatccaactccatcaccaccctcaagtggtggtggaagttacaatccaaccccatcaactcccccaggtggtggaagctatgatccaactccatcaccaccctctagtggtggtggaagttacaatccaaccccatcaactcctccaggtggtggaagctatgatccaactccatcatcaccaccctcaggtggtggcggaagttacaatccaactccatcaactcctccaattggtggaggctatgatccaactccatcaccaccctcaggtggtggtggaagttacaatccaactccctcaactccccctggtggtggaagctataatccaaccccatcaccacccacagatggtggaagttacaacccaaccccatcaccaccctcaggcagcaactgtggcacaccaccacatgacccctctactccaacaccctcagtcccaacaacaccatcaaccccatcaacaccatcaaaccctccctcaggaggaggtggttactataactcaccaccaacttatggaggtagtagccccccaacaccaatcactgtgagcccaccttcaaccccaattgaccccggcaccccttctatcccctccacacccccttaccttccttccccaactcccttcactggtacatgcaagtaagttcctacttcttttcactacattgcactataaactatgatatgatattcagccacactgttaagtaacctatgggaccttgtcctctaaattgcagctactggaacactcacccaggaatcatttggggattgctaggctggtggggaaacttaggccatgcatttggtgtctctagtatgccaggatttggtgccagtctcagcttgccacaagcactttccaacactagaactgatgggctaggagcactctacagagaagggacagcttcctttcttaattccttggtgaacaacaggttcccttatacaacccagcaagtcagagacagatttatagcatctcttgcctcaaataaggtagcagcagcacaagccaacctcttcaagatggctaatgaggggcgaatgaagcctcgagcatgatatagttaatttggtttgtgtgtcagtttatttagttaagaatattatgtctaagacttcttctaagagtgtgttatttaggcttttatcttgtgtaatatggatatcgttttactttacaagttcatgttagcctttatggtttcttattctgtaataaagtttatatattgttacttcaatagttcaattatatctgcatccgaaagtacaaacttcttttcattatatatgaaaaaatgcaaaattcttattaagataaacttatttcattatataaaaaatcacttcaactcagctaaaatggaaggcaaaatcagaatctgtgatataattcatcaaataaaaactgagtattgttataagtacagcactaaaagggtgcatcatcttctcattaatgaaggtccacctataaggatgtacataatctgtcaaaagaaattgattacccataaagtgtaatttagaaatagccctagtctagagatgtcgattgttcatgcaacatgattgcattcaagagataagaatgatatggtgagtcttgaaaacgtgaacaaggtacaaactgtaaagaatgaagttgtctagaattgtttcctagtgaaaattcaagggaacggttttgttgccaatatatatgcaaacaaagacaatagatggaccaagatgctggcaatggtgcccctatgtgaattggaaatgatgggttacagtggcacaggaaggattaaagcgccatgtgagctccaattaatgtcttttaaagtgcctcaaggggaagtgtacaaggctgtggtatggtccagaacaattacaccggatggtaaagactataaaaggagggtagtcttcccagtgtaatgtaaaaagattcattatatctttaaaacacaaacacatataaaacccaaaacgcgtcttcaacttaccaaatacttttgagcaagataataactgagatattaaagacctctactagtttagtcttcccagtgtaatgtaaaaagattcattatatctttaaaacacaaacacaaataaaacccaaaacgcgtcttcaacttaccaaatacttttgagcaacataataactgagatattaaagacctctactactttagtgtacttcgtagctagaaagttatattgctttgctatatataatatatttacttgtgttaatggtaaggaataaaacgaagaacatggatcaaattctttgtgatttaaaaagaaagtatttttttaattcaaaatatgtttgaaaaaattatgttaattagataagttttttggaggaaaaaaaaaaaagtaaaagcctcaaagaaaaagttgggttgtgcttttatttttcacaagtaaaaattaataaattctagataaaaaactataagaaaattatatgtaaaagcatttattttagtttatccgaaagaacccaaaacttttaattttaagaatttcagtgtgtatataacttttaagctccaaaagcttttgaatgcttaagatgacaaacaagaggaatatgaagtcatccatatgtccaaggtagtcaaattgagatcccacctaggattggaaaggaggggaacatgtatattgtaagatcctaacaaggatagtaagatctcacataaaatacaatatacaatatacaatgtttccaccccacatcacttccattttcaggagcattcttgtgcttagaacctccacttgcagggacaaaaacagcaccatataattacaagaatttggatgtttattggtagaaaggaagaaagctctcaaaatactatagtttagatgcttactgatagaaaggaagaaagttcccacttcccattcataattacagtagaagtgagtggaattaaaagaattacaagttcattgttcccatggtgccctcatatcaaacacattaaatcttaggatgaatggcaaaaaagataatttcaaaagttattccatccactcccctgtcaatttgaagggaatagagaggtgtggagtggaaaggagtctccttgattccattccttttcctttctaaacatccaaagaatggcatcttttactatctcatataatttttctcctttccacctctcaccattaatacaagcaaagggtaaaaacccaaggaaaattgtatgcatttaattaaaatactgtcataattcttcaccttgaaaattagaagccctcatctaaaacttgcttcaattttattcatttcagttcttatttaaaaattatgtttgcatttcttattttaaattttattcaagtatagatgtcaaattgggtttagatcatagggcaaataagtctagtagtcaaacttgcaggatcaggctcataatttgatagccatattaaaaagtgtattttgaaactcaagtccaccagggtattcaaatttcaaagattaaacaatgatttgtgcttcaaatctaaagaaaatggtagaaagattacaattttaacaaaatttaggataacattcagcatactgcttgccaaagcacatatggtattggtacaaaggttcagaggcataccttttacatagataacttctgacagtaacacccaattaagaaattccagcccttgagactcaatctctgataaagaaaccactatagcagtttttacatgagtcaatggatttcaaattgaatttcaggaaaattgagtcgaaggttaggtccatcatatacaagtggtttcaatgcaggtaagttttgatgagctcatgtgagattcaaaccatttaaaaatttggtcagaatgcacactagtcatctcatggtaagcaaatgcaaggtttagctcctcttggatgtgagggaccagattcttatccagcagaagagctttcttctcctcaagagcctttttccatttgatttgacgcccatctttcctcatataaccatttttatcaataaagcccttttcctgaaagaactcaaataaatttctggaaagagcctgatcaagccctggaattctatcagctaaagtacttggtgacaatggaaactccatacattcaacaacaccaacatcaatccctttatcttttaaaacctccacatactcatctattttctgctgcctataaagatctttgggcatgtgaacaaaaagggtcggcgggtagtcccctttaacatcaatttgctcaaacatcccctcagcaatcatgagcacagtactactaaacttcatggcggtggcaagcacagacacgaaataccctccagaagaagcacccaaagccacaacaggaagcttctcaagcttccttctaccaatccaccactctataatgtccttaacaaccaacacttctttaccaaatgtccaacatctttgtgcacttgaaatagtaataacagcaaaaccatgggcaagaccatggagtacaagcaaccgttcctcaggcaaaccaatgcaatgagggcattcagcggacttgtcccagaagttgattgccctgccattgcatccatgagccagaaagagaacacctttaggtgattcaggcacttgccatatcaaatcagttccattccggaactcttttgttggatgcaaacgcaccaaagagtcaaagctattccatttttgtttaggaagttcataagctaaactgggattagcaccatcactgtcataacgaaatactaaaaggaaaaccactaacattagaatcaatgtaaaaaacaagaggaacacagaaacccggcaattctgagctccactccatggctttggtttgaatccacgcttcaacatgctgcaagaagggttgatagaaagggtagaaaagatcaaaattttaccaaaaactttcttgagagaagattggtaaaccatgaagggtcgatagcgttaaatcaaatgcatcattcaaatcagaaggagattacctacggtgttgaatctccaaaatcgacactacttctgaagtgttgagctgaatctctaggtgcaaggataatccattggatgaaatactgaaatgttctgtgcggtaaacgatttgcagttttgcactttagtcggttgctggattactgtcatttgggatctgttgttttcacctctttttttgctaagttcatcccttaccttcttcataatttttgaacattaacacctgatttttttccgaatgacacacaatatcccaccttaacgatttcaaatattattgggaatttgtgtaatacaataggcgtattagtataatgttttctaaggatattattgtaacaatagaaaaaagaattatgttatgtgtaattcgaaaaagaatatcacaagatactggtgcagtttgcttctttgtatatataaatacttttgacaaacttatttccatcttgcagacaaaaactattgcatataaattaacatgtgttaaatttatattaaaaagtcaaataaatatgtatatttagtttaatttcctggtctattagaagcagaaatccctgaatttatagaatttctgcctaagatcatggctgtaaattaagctatattcaatttaaatgtgactttaattcatcttttattttgaaataagagtgaatactattattctaccaatataaattaattatattttggtttcatgaatgtatgtccacagtgagtttgacctttccacagtagcattttgtgatttaatgtgtacgtcaactcctactcaccaatctcatcttcttgagcaaggtatgcacaaggaacatcaagtaacttgaatgtatgtccatagtgagtttgacctgtccacagtagcatggaattttttttattaatttaattaataaaaatacatataatttttttttaataaaaacatatcatatacacatcacttttaaagattctcaagtcataaaacattaaagtatctgtgctgcaagttaactttcggcagcaatcatttgttttttaccctatatttgctaattctatgacattcaacaagccagacctttggatttaattctaatatgcaatgacattattttttttttttggtaaattaagaaaaaaaattagaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatatataaaaacaaaacaattgtttatttcattaaaaacattctttttacaaaataaatttaaataaacgagctcacaatatatattcccaccgatattcttattacaagcttgatcctgctgttttcagtattttgttaggagacaagcaaattatattgtacatcttctaggaaagacatcgcaatttcatgttagtcactagttttttttttttattacatatcatcttgtattaagactattcttaccaatgaaatgctttcagttgttttacttaaaaaaaaaaaaaaaaaaaaacttgatcctaatgaagaagcattcttattctagttgatacgatttgtgacgcaccttccatcttgggtcccagcccgcacctttcagactcatattgggctaacaacagaacagggagcacttaactatttactgggccaattgtgggcccattcagaagcaccaaagacaacaaacatcaaccatgtgcatgtgcatgcttggttccttcagccaccttcacctttgctccataaatttagcttttgactttgggcattccatcacgttcctccttttcacatttctcctttgtaaagcagattccatattggtttcaatatgcttaatcatgttatatttttttttttttcttcctttcaattatattctacttttttgtttaactcgttacccattttaaaattttaggatttcatggcgcttatgcgtctttactctttagtaatttctttaataatttgttgttagatgtattttgtgacatataaatacgttgattttggaaacatgcaagtttttaagctcactcttgtattaaaattcaatagactctttcacacaaaataattctttcaaattaaagcttaaacagaataaggtaaaaacatatttattgtcttattaattattaaacttgagcaaattcattttcaagattcacatgttagagttacaattagcttttgaaagaaacaaaacgatggcaataaaactctttcttgagtataactaacacatacacacatatatatatatatatataaaagattgttaagatagtaccaaatctttagtatgaattttgagttcaagatttggtttttattaaattttctaataaaaaatataaataaatttctaatatgaaaaatgaattattgaagaattctgaagatctgtataatattaaaaaataataatttatttttcctctcttttcttaagatctcaaaatgagatttatcacaaaaaaaataaatgaaagagattttggtagatcttcaattctatgtaatattatgggatcaatcaaaaagtggtctaagatcctaatttagaatttaccattaaagatatttttatatcttctcttagtgtatgtattagcaatttataaaaaatgtgaaggaccaaaaaatcactaatttaatattttaatttatttattttaaggatgttaccgtaatctgattttaaaaaaattaaaataaaaaagagtatgatttctctctcgcctttaatgtctttcgttccaatgcattttgtctttgcatcttctctcagaagtacatccgacaactcagaattacaacagcaggccaacaactattgcaacagcaggccaacaactatacctagattattggcctacgacaaacaactatacctagatgatcaatataataagttcgttagtcatcatatatattgttacggaaatgtattatcttgtttgaaatagtcaaacaacctctgttagcccacgataaccacccagaaatatggggcgtggccgttatcccccactagccgatatctccgcatatataggaactgcgcgttagctgcaaccgcctgagcaacaacatccaggtatcctataaatacacagtcattcatggtgaaaggtacacacaattcaagctctctcttttccttcacacctgcacacaccgcacccccaaagtgtcgtgtataccgtgcggtgatcttcttcctcaagtggcttcatttccataggcttcttgagagagagagagttcgatcctacagtaaatcatccaactccattgttggacatttctgttctctccgagcagaacagtggcgccgtctgtgggaacgataaaattcgattcccatcatctatcaatggctaacggtagaagaaatccaagttccagacgagaagacccacccaggaatccgactccggaggaggtggtggcagaagacgcgtcatcccacacggcatcatcccgtgcggaacctacgacgcaggagccggccaacataccaccggccgaccaagagaattctcaacgcttcatccagagcgctctccaatccctgttggcccgaatggagaacttggagaagcgttacgagttacaacgccaggaagacatccagcagctgatcgctcagctggaggatcgcgacgacagaagacgtgaggcagagcgtcggcaacatgccgacgataggcgcgaagaagttcatacagaagccgaccatgcggctgcaagaaggtcggtaccatcgacatcgatccgagctgccgaaaccaatcaacgagaccccacccaccaatctgaccaaggaaaatcattggccatttcacatacagcggaggaacgaccgacgggggcagtcgcccgtcatctcggtcaaggcagtggcacatataggaggaagtatagccggggccaccagaataatagcccgttcgttgaccacatagtcaacgccccgttcttggaagactttgatgggtctttcttgaacaagtacaatggaactcaagacccacaggtacatatcgatgagttcgatatgcagatgtgcgtacgaggaatcgacgagccgatcatatctcgaatcttcgcgacaaccttgacgggagccgcccagacttggttccactcactgccaccaaggaccatccgcaatttcgaagacttcggtcagaaattcttgctaaatttcgcaacaagcaagaagcagcccaaatctgagttcgcgttgggaaagatacgtcaacagaacggggaaacactacaaagctatttggatcgatttagagaagcagcactgcaggtccacgggttggaagagaacgtccatgtctatctcttatcggctgggctcaacggatcctcccgacttgccaagtcaatatacaaggatcctgttaaatccttgaatgagttcggcatccgatcccagaaatatcttgaactggagcagatggagatcgccaactcggctccgaaagataataaaaaaccgacatcaccgaaaaaccgacgaccagaaaacttccaaagtggacaaagtagccgacatccggccattctcccaacaggccgacctccgcgagggttcctcgacaaccgtcctagatcggggaaatatgaatcgaagtttgaaagatacactccgttgagcactagccggggacagatttggaaggaggtggccttcacggagatgagaaaagtaacccgacctcctccagtgatacggaaagaagggatggattatacccgatattgtgattttcacaatggaccgggacatacgaccgaccagtgctgggaacttcgagacgctatagagaggttcgtacgtgaaggcaagctgcgtcaatacgtgatccgaacccaggggcaccaagccaagaggaaagcccagcaggaaaataaaccacgggaggacaaaaaaagtaagaaggacgacgagttcccagaacccgagttcgaatgcaatgtcattgcaggaggaccaggaggaggaggcgatacggcaaatcagcggaagaagtacctcaaggaagttatgtcggtaagagaccggccaaagttcaaacaaaccgatagcggggacatcaagagagacacacctccactgatttacttcactgacgaagatttgaagggagttgtgcccggacatgaagacggtctcgtcataaccgggacagtcgctaacttctgagttaagcggatattcgttgacaacggcagttcagccgacattatcaactggagcgctttcaagaagctaaacttgaaagaggaagacctgaaaccgtgccaaacaatgctgtatggtttcaacggtgaaggtaccggcctaaagggggtgatcgacctccagctaacattgggaacaagggaaggcttcaggtcggagaaggtgacgtttaccgtcggagaattcccgtcgccgtacaacattatcctgggaaggcccacgcttcataagtgggatatcctgatgtccacaaagcatcagaaaatgaagatggtgggacacctcggtagagtcatcacgatctgcggagaccagaaagagtcccggcagtgttattacaacgcgatcagagaaacggagggcggtccgtcgtcaccacctcgacttcgccaaggggagcaaagaggatccaagaccggggaacaaccacctcggaaaccaatcaatttagtggagcttgatatgcgagatatagaggaatggagacccgagccggcagacgaactcgaagatatccagatcggcgactcttcgtcccaaaccaccaaggtaggcaagcaggccgacccagaaaataaaggcaggctcatccaatgtttgaagaaaaatcaggacgtctttgcttggaaggcgtccgagataccgggaatcaagcccaccttttgttgccacaagctggcaatgtatcccggctctaagccgatagaacagaaaaatagaaagctcggtccagacagaaagcaggcgttgaccaagcacatcgaagaattgcttgaggcgggattcatcaaagaaatccagtataccacctggctctccaatgtagtgatggtgaagaagcccaacggaaaatggcgggtatgcgtcgactacaccgacttgaataaagtctgtcccaaagactcgtaccccatgccaaacattgatcaactcgtagacgactccgccgggtaccgactgttatcattcatggacgcctactcagggtataatcaaatacccatgcatcccgacgacaaagaaaaaacggcatttcgaggtattagtgctaactactgctataaagttatgccttttggtctaaaaaatgcaggggcgacctatcaaagaatgatgaataaagtcttctcggatcaaatcgggcgcaacattgaggtatacatcgacgacatgatcacaaagacttccgcaaccggggaccacatccaggacctagaggaaactttccaaaagctgcggcagcataatatacggctgaacccgctgaaatgtgcgtttggagtaaaagccgggaaattcctagggtttatgttgacccaccggggaattgaagcgaacccggacaagtgcaaggccgtcctggatatgcaaattccgaccagcaagaaagaagtccagcagttgacgggaaggatggcagccctgacccgattcctaccacgatctgcggagaaggcccttccattcttcaagcttctaaagaaagaagctaagatcggatggaacccgacgtgcgaagaggcatttcaacagataaaggcctgcttggcctcaccccccgtgttgtccaaaccagaaccgggggaaacgctcatcttgtatctctcggtcggcgaagaagctatcagtgccgccttgatcagggaggtggataaaactcagcacccagtttattttataagtcgagccctcaagaactcagagttacgatatcagaaactcgagaaagtggccttcgccttagttaccacggcaaagaggcttcgcccatacttccagggccataccgtcatcgtccgaacaaatcaacccatccgacaagtgttgcacaagccggatctggctggacggatgatgaactgggccatccagttatccgaattcgacatccaatacgaagcccgccaggccatcaagtcacaagctttggccgacttcattacggaactgacaccaacgtcgaccactcagcagaaaaacaaactctggaaagtatacgtcgacggctcatccaacgcaaaaggaagtggcgccggggtcattgtcgaaaaccccgatggagtatcccttgaacagtctcttcagctcaaatttccaacttctaacaaccaagcggaatacgaagccttgattgcaggtttgaagcaggctaaggagcaaggagcaacaagggttaatgttttcaccgactcgcagctggtttccgcacaaatcgaaggcagatatcagactaaaggtcctctactagccaaatacctggcgacagtaaaggaaatcatggctgaattcgatgaagtaataatcgcccatatcccaagagaggaaaacgccagagccgacatcctatcaaagttggccagtactaaaggagcagggatccataggtcggtcatccagcaagaactcgcccaaccggcatgcgtcatgatcatactcgttgctgacgactggagaagacccattgtcaattatctagagcaaggaatcatcccggacgacgagaaagaagcaaagaagttaattcgagaggcggcggtgtatgtaatcctcaacaatgaactgtatcgccgaggtctacatagcccactattgctatgtttaaactcggatcaagccgagtacgtgctctcggaaatacacgaggggatcaacggacaacacatgggcgctagggctttagcactcaaagctctccgcgcaggctatttctggccgacgatgaaagccgacgcaacagaacatgttaaaagatgcgatgcctgccaaaaacacgcaaagatagtgtggattcccccgtccgagctcggattgatcactgcaccgtggccattctacaagtggggtatggatttactggggccgttcaaagctaccgagggtcaaatgcgatggctaatagtggccgttgactacttcacgaagtggatcgaagccgaaccattatcagccatcacctcagctcgggttcaaaaattcatggagcggaccataatagcaaggttcgggattccggccgaaatcgttaccgacaatggaacgcaatttaccgacagaacgttccaagcaatgatggccggcctccatatcaaacatcactttgcttcagtcgaacatccccagtccaacggccaagcagaagcggccaataaagtcatcctcgacggattgaagaaaagaatgcaagacgccggcccgaattgggtcgagcacctatactacgtactttgggcctacagaacgacgacccaaactgctactggcgaaaccccgttcagaatgacttatggttgtgaagccatgatcccggtagaaatcggacaatcgtcatggagaagacagcacacagcacaagaggaggacaacaatgccgccttaactgccgagctggatttgatagaagaagtccgcaccaccgcccaccgtcgggatctccatcaaaaaaataagctggccgaaaggtttaacaggaaggtaaagccgaggtcctttgaaaaggacgacctcgtgttacgccgagcagatatcggaaacaaaaacacccgagatgggaagctagcggcaaattgggaaggaccatatcgcgttatccaaaatcttggacaaggagcccacctattggagacattgaacggcaaacgagtccagcgaacgtggaacgcggacaaattgaagaaatattacagctgacaatgtacagccgaggtccatgtgttttcctttagttggcttctagtcggtcatagggatcatggaaccccatcatgtgtttccctttagccggctctaagtccgtcatcggaatcatggacaccatgtgtttccctttagttggccttagggcccgtcattgggatcatgggattagtgattttcattagattttgtgaaccgggaacatacacccgcgcaattctattttgaggtcacaataattctcagtaaattgttaaccgggaactatcacccacacaattttacttggaggacaaaaactgtaatttttcatgtctttatcattagattttgtgaaccgggaacatacacccgcgcaaatctgtaattgataccatgaattaataaaatccttgatgcaaggcatatcttcgtgcacgaattctaattgcttagtcgttgttttatattaacccggtcctgatcaggccggcgtaattgttcgatcactgatgaatcatcagaaactgaaagaattacatctaccgattgataattacgaatatattaacagttgctaaggccgggaactagacccgtacacctttatttaatatcggccaattgattcgggttaaatattcggctatgtacattgacgaaaaatcgaccaacgagtcaaacatacttggccgttggaaccaaatcacgagaaatgtgaaggtgtaaaccggcagatatcattacaaaataaagaaattgtttggtaaacagcaacaaaagaaaatacaaaagaggcgaccggcattccggcccttcaagcctctccgccatcttgaccgggcaccacttcaggcggatccgccgcgcttgcttcctcctcttcactatcggacatggccaaaagttggccatcaccaatataagatttgaaatgcattccctcggtgttcagctgcacaccggggttgaggaagcggatctggaccagagcattgttgaaggatgcctcggaagacttagcaagctgagattgaacaaagttcaactccttataagcctcctccgcatccttgaccttcttctcattgaagtccagcagttccttctggcgcgcgacggcgtcagcagcccggcgtttgtaggaagcagccgactccttgtacttggccacctcagcacgagcggcttcagtctccgcccgagaagcaccgagctcggcttgaagagagtccaattgtacccgagcggcctcaagatcggcagtcagcttagttgccaactcccgagcctccctagcctctgcttggcacgcctccacttctttgtcggcggcagcgacccgttccaaagaggaccctagctcctgctgaagccggcgcacttcaccctcggaggcctcgaggtcggcagccgctgtgcaggccctcttgtttaaggccaccaagttcccaagcaaggaagcggtcttgtgacaggccagctccaaggaacccagctcctccttgtcagaatcgctgaacgggagcagctcggaatatctttttggcgcccggagagcctggaaaagttcccgtgttaccccttgatcccaaagagttcgaggggatacacggaggtgctcgtcagaagggccgggcactacggcagcatcggcggggactggggcatccgtcgttggctcatcatgaacctcaacggagatctcggccaccggggacggcggaaggtcggatgaaggagcctcggtggtttggtcggccaggtcgagagattcgaccgatacggactcaaccacaataggtgccgaccgagtttcgccggctgcctgctggtcgtccgccggtcgcttcctcttcctcctacgcttaagagcctcaagatgcgccggcagaggggcacgacttgtgttcatctcggtagctgcgcaaaacaagcgttagcgaaagtatattacaaatattcagacttattctcgaaaagaattcaattcaaactgaccacactgaatataataagatatgggggccattgttcccgactctttgtatgaaattattcgggcagcagaagtggcgtcagaatccgacaacagggtctcgtcggttcggtaggaagcggagggaaggtcgtgatgggccgaggaccaatacaaaggaaatttccaaggtcccgaagaagaatcagcagagttgagaaaaaatggacgttggccgggttccgccacaactttgaaaaatttgtccttaaaacccttaaaggactcagcatacaaagagaagagccgacgatcaaagtggcgatcgacccgacctcggaaggaaatccatcccttccggtcggcaggctccttacccgaccgactagtttgaaccgcgaaaaaataaaagaataaaggacaagtacaaaggagctgtagcttctggcaaaggacctcgaaggcttgcatgaaagcccagctgttgggatgaagttgggagggggctgcgtgcaggtggtgtaacacttgcatctggaagtcggtgaagggaaaacagactcccaaccgagtgatgacatctctataaaacaaaaagtagtcagggccattcccctctcgagaagaacagatcggttcgcccggaaggggaaggcagacatggaaaccctcctgagccccgaaaggaatcagagcgaggtccccggaattcattgttgaggtatgctgcaacacctcgtgggttacccaaggaaacctacctattagagcaggaggagtttcagaccgagacccggttgcagacccccgaactgttctggcccgagatgagtccattgttacctattaacaataaaaacaaatatcagttcaagtacctggaaggaccgtcgcgatgcgggaaggaaaggtcgaagacggcaagatagatccttcaattgaagtcggcctttcaacagaggtcggcccggtgggattatgactcggtcgggccggaaaggtattggtttctttaggaacaggtttacgaacccagacgggtttatggcggcatcgatctaacactccctcggctcgtctatcatggtctatactagctagatatatgaattcctctatgcaatttgggcagggttcataccgaatctctgaatccggctcgggtatcgggtaggtttcagattcattcggagaggcaatatctgaagggggggaaaccctagcagacgccgctgcttgcaaggccagaagcgctggtctttggcgagacgaggaccctaaactagaagaccctaacctggaaggccctaatctggaaggattggggggtttggagatggaagccttggaacttcctggggcagaaggagttctgagtaaggattttttcttttcctcttcaggaaggggcaagccataaagccaaaaggcagcgcgaggagaacaggatttgcgaatctccgcctcttgctcaggggtatatttcatgattgagggtagcaatgcaggacaagatgaaggagtgggaagtgtgagaaggaaatcgatattcaatctctgtgcagaatcagataaaatgaacaaaacccaggaaacaacaaaagactgaagcgataaagagaaagggaaagcagaagaatacctgaaataagcgaaggaaatgaaaggaatgaagaagaaaacacagggaacgcgaatgcagcaatgaaagttgaaaggagagatatgaggaatctgcagtagaagagcgcgaacaagaaggatagggagaataccaagggtatggatgaaagaacgaagtaatgatctcaataaaggggataaaactgaaagggcgcattaaaacacgaagcgtaaccgccagaattcaaaaatgctggagtaactgttgagtataggggcatgattgtctttttagccccaaaagtcatgattgaaaaatacagaggggcagcagtttataagacacgtggcgataggggaataagagacgtttcattcccctatgcccctagtaacaaaggctgcgttgaaaagacaagttatagctcggcgagcatactgaaatgactgatggaattgataggagacttgatatcccgacaaggggcagaagtcgaggggcagaaatcgagcatgcgataatattgatcatggtcacatcggctcgaccttggtaatgtcggctcggatagtaaatacttcagttaatagcaaagaacagtcgggtcggacggggtcgccccggaacagcttccatcgcctcgatacaagtagagatgacatcggctcgaatattaaaattcctcggctcggataaaaaagcacaccggctcgaatgataatcatgtcagctcggacgtcggaaaacaaccgactttcttatttatacatcccggccatccagaatgctagatgaccgagctgaggggcatctgttacggaaatgtattatcttgtttgaaatagtcaaacaacctctgttagcccacgataaccacccagaaatatggggcgtggccgttatcccccactagccgatatctccgcatatataggaactgcgcgttagctgcaaccgcctgagcaacaacatccaggtatcctataaatacacagtcattcatggtgaaaggtacacacaattcaagctctctcttttccttcacacctgcacacaccgcacccccaaagtgtcgtgtataccgtgcggtgatcttcttcctcaagtggcttcatttccataggcttcttgagagagagagagttcgatcctacagtaaatcatccaactccattgttggacatttctgttctctccgagcagaacatatataaaagtcacgcacaattaatttttaatttttaatatccgtgtatgattatacaatttggatttagagtttttatttcttataataataaaagttcttatttgatatatatatatatatatatatatatatatatataaaagattgttgcaatgcattttctctttcttgttatgttttgcacatatcttctctcagcagtacatgccacaacccagaatcgcaacagcaggccaacaacaacggctctaacccagtgatttccccgcggatcatgatgatccttctctactgtgtttctgcggacgcgctagtgcaatgacccgaacaccaatgttgtttatccctcatcacccaatacctcctgaatacttctgaacctcaaaacataagcaacctgaaaatttacaagaatagctagaattgcacccacctagcttgatcacaagggaattataacttttctttgcctattcatttttagtaactaaagtgaaatgtcgaccaaacttgtaaggatggaaataaattttttgttgtaaattcaatataaataatgtgtgattcacatgcgatcaaaatagacacatatatgcatgtgagattcaagtattattattactttctccttaacaattatatttagaagccaatatagacgaaattgacaaaaacacaccctcacagaatgtaaaaatgttgtctaaagttaatttagagataaaaacagagcttatatcgaatcctattaaatatgcatatcataaaatagaatttaattaggcgaagagtccaaaggctcacactatcactgcaagctaaaaaaaatgtctaatgagtcattaaaatggtgacataacatatataacatgaagtgatagctcaacagtcaagaagtgtacgtagatatatataggtgaaaaaagacagcatatgtttcatatggactggagattaaagtggtaaggactgaatttaatgttaatagtgaatatgacataaagatataatactacattgaatgaaaataatatctctctctcacaaacggaaaaggacggacttaaaagtttaaattaattttaatttattgattatttattgtccaaatccataattctatccacttatcatcctaatgatgtgaggaatgtgaggcaatttttttttttttttgccacaagaacatttttcattattgaaaaaaaaaaaaactgaatatatgtacagccacaacatccttatccatttcattgtataatgactcaaggtagctagcgtgagtgccatatttcacgtccacattatcctgaatcaacgtgcccatagtgggcttggtgtgatataattcaagaatgattaatgaggtgctgattttccatattcataagaaaattgtctatacattattatttaattactgatgaccaaagataatagatagcatatttttttcaaaaaatattaattgctaatttattgattttttttttttacaggaaaaattaaacttaagacatatttattttttattttttcttaaccactcaactcatctatgtgcttgctccaattctgcatcaagaatcaaccgtttgaatatataggagaaattaaggtcagacaatcatgtcgtagtcctttgtgcatatactgttcctgcctgtaggaggtgtttaattttggtagtcttatcacgttgagctttataacaaattttaagggcggtacacgagtaagaaataaagggagaattgaatatttttgaaggcattcaattatatgtttaagttaaataattaattaataagactctagaaaaaggaataaaaaaaagaaaccaaactaatagatacttaaaatgcatgtgtttgatttttaattatcctaccaattgtaaaactcatttgcatgatatattgatataagcaacttgacaaagatattgcatcaacatgcatcaatgcatgctatagattgctagagctgttagttccacttaacatatgagtgctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactacttttcttttctttttattaaaaaggagaatgacaaaagagacagataaattattaaacctactagttatagtattattttctttctattatgtcttttactttccaacgtaatcatatagttttacgagaggatctaaatcccggggtaaattggtagaaagagaggatttaaatgatatatagtagtatttattaaaaaaaatcatctacaagttttttttcccattatatactttttctttacgtgtcatcctcatctaattctttaggtatacaatcactaccacttgccatatatttttagaactctacatttttcaaaatttaggtaaacacttactaataataaccatttttttaatctgaattataatcataagattaatattagtattagaattgaaccaaaccaaccaattggcatgcactggttgaaccagaaattaataatcaaaccagttcatttaaatctagaaatcagtcttacaaaaaactggtataaaactaattgaactaatccaaaactggacgaatcatccaagtttgaatcagtttgcccaaaaaaactatttctattttatattttaaattaaaacttgatattataattgttgatataattctaaaacaataatatgatgatagataattatgtttattatctttattttttaagcgtagttactaataataaatattattatgtgttattaaatttaaatattatgatatatttgatttagtttcatatttaatttttaatattatatattatgagtcatgaattttataaatttaatttattttttttaatattatgaagttataaatattatgtgattttttgtttaattttatttaatatattatattaaaataaaaataataatattaattataattaattaaaccatttcacctcccactctgatttttaaaaccttgattcagatgtgtggctgtacacaacgttttaaaaactggggccgtatgccgtaccaaatactactactacttaacatcaattaaatctaagtggtagattccttttcatatgtccatccaaatctaatttattaattaggatagcattgataaaacccatgcacacatcattccataatatatagttttataaacccaaatatatacctagaggctagctagatattttacttctgattgctttctgagtacatctagcgttgggttgcacacatcattccataatatatagttttataatatgatcaataagtatagattaatattttaaaaatggatacacagttataagagcccaaatccgcattggaaaaaattgaacaacacgtggaggttggagacagaatcgccgacttcaacattaatttctttaaaaaaaaaaaaacgagtgaaagtggtacagtggtagtatttctttgttaatagtcattaaaaacgttagatttccaaaagatagtacattattaaaagtttttaaataattttttttagaacatcaataaaaaattaaaagtataagtttttactaaaaatgatatttttttactgctatcaaaaatgctgttaattaatataggagtatatccgagttatttttagcatgatatgctattattattattattatttttattattatttatttaacaaatattttaagatattagtttataagattcaaattttaaattattaaagtaaatttaagtaaatacaaatattttttaatcattagcactattattttttaaaaaaaacttttctttgcaaaatttaaaatatactccatttgtctttaaatataagataattttaattaatttatacatattaagaatttaaatttaattaatttaattagtaatattaaatttattaaaatttataatgttttttaaaaaattatcaagatatgcctcacttttttatttttaattatttttcatctaattaatttatatgtgctaatcattttcttcaatttttataagataatagatgaatttatcttattaatttataatatttattattaattgagaacattttaattaaaaaatattaatacaaaagaaaacttaaaaaaatataataaaaagaaacaaataaatttaaaaaaaaagtgtctaatattagaggtgttcatcaaccgatcaaaaccgatgcaaaccgtggtaaccgaaccaaaaaatcgataaccaaaataactgcaaaatcgaaaaaaaaaacctaaaattttcattagattggattggttttcggatcggctggtgaaaaccgatccaattcaaaccgatccaattataaatcttatcttaccctttacctacttgggcctatttcctatcatagcccaaaaatcaaaaaaccaatacattgttctttattttgtccaatgaacgtgtttgtccaatgaaaattagaaaatggtgtttgtttttgttcaatgaatttgtttgtttatgatagatactccttattttgataaaaataagtctcataagtttttttttagactttttaaaaaatcgaaaatcgattcaatccaaaccgaaaaaaattggattggattggatcgtatttgaaaaaatttcaaatcaaatggatgatcaaatgaccaaaccgaaaagattagatcggataattttttcctccaaaaccgatctaattcagaccccgaacatccctatctaatatataaagaaggaggcagtattaatatttattttaatttaaaatattttcacttattataaaggaaaaaaaaatcatatcaacagacgaataaaatgttgattatgtctatcagtttatatattcttttagaaaaaataaaatgactaaataataaaaaaatgaaattgaaaaaaatactggttataggcttatagcctcataggtaccggcagcatctcgaagaagcgggtgtcacgtcatggaggtgtcggcgaaagagtgtcaaaagagtaaataacgtgaaaaacagtggcgaaaagagagatcgccacaccaaggtgtaattgctatattaatcatttcccgcgactttggttttcgcatttccactctctttctttatctccctcactgcagcaactactactttctttcttttccccgtaactaaaaaactcaaccctcatttcaatcgcagaaaccgatccaaacacgaatgcaacacacacactctcttcgtccctcagatccggtgccgattcgatcggagagaaagctagctagatatagcttatagggaatggaattcagaagatgaagttctatgtatctgcaaaggggattaagagactcgacgccggaaaaggatccgccaagaccactgctcctgcctacaccgtccccgctcgccggatttccaaccggatggtggtggtgctcggaatcgtgttgctgctcagctttgtgagagtggcggttttggtgctggaatcttctgcggtgtgctcaacctttggtaatttttcttttccgattcatttttttacttttggttcgtaattttttcttttttcttttactgttaactgttttgtagtagccagttcggtaaggaaaacagttgagtgtgggacaagtacatatgaatgaatttcagtgtatataatcatagtgaaaataataaataccgaaacttactatttccagcttcatttggctgcttcttctaggtccaacataataatctcaaggaaatttttatttactatctttcaaaattctcttaacgattactttaataatactggtatttttaagaaacattttgaaatgaattttttaataacaagtatttgctgcaattaaaacttttaataattattttatatatataaacacatgcaataacattctttttgttttgatatttattttttcatagagaaatgcagttgtttcaatttaattagataaaacagattctatgcatagtttaaacgtgaaatttataaaacaaaggaaaggataaaagtgtagtggaatttaaaattaattaaaatattttgaaataatattatttaaataagtactttttatctttacaaatattatgattttattattataaaaggtgaaaaaaactagtttaagttttgtgatacctttaattttttaactattaatagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatagtataaaatgtactttttttatcagcggaaataataatattatcaaatgcactcataatactatgtgcacttaagatcactaatcaccaatcaatattaaatcttaatcagtaatcaaatcagtagtttaagatgattgaaaatgatttttttatctcattgataagataatatgttaaatgcatatccgtataaaagagaagaaaaatacagttaaggtgtctaattaaaagagttgatagaatgaaagtttcactcttcatgttactttattaaattaaatgcaatttttgatctattttcttaatttgatatattaagttttaattaaaaaattaattttaatttttatatttttgcaaactctattttgatacattaagttttaaataatttattttggtctttttataattttttttgtcatactaaagttattattttagtagtagatggtataaaaaaatcttcacactgataggacatcaaaattaaacttaaatatttagcttgtttaaatcaaagttatacaaagataaatttaactcttaaatcatccttaaaatgagctcatcttttgttgaaaagtttatgagagcatctatatatgaaccattgtaattgttgcagattgcgtgggatcgacatttttcggcggaggtgacgccaatctggtagaaccaatctattattatttttgacttgtttatttttatttgaataaacaacttataagtaatcctttggataacattttttaataaattgtatgatcattaattcgttttaaggtgagctggataatactggaataaataatttttaaatttctatgatttatttttataaaataaacgcaactataagtacactaatatatatatatatatatatatatcttatttttaataaacaagcttattagtatttatttaactgtattttttattatgtgttgtaaaaaataatgttaagataaatggcataattttttaaatttaaaatgaaaatgaatttaaatacaaacactagctgccagcacggacgatatattgttcatatggggatccgcaaaagaaaaataataagacaaaataaaagtttagaaaaaataataagacataaatttttattttgtcttttttttttatcatatattcatatgggatccgacaaaaagaaaaataataagacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtatagaaaaaaaagactatcaaatgataagtgataacaacatattaaacatataatctattatttaataaaaaatcgtaatcaatatcttacggacacaacaaatgttaaaataatttatttaaaatttcagaaaatgggttagaaagattcagagatattttgataaaaatgatatttgactatatattctaagcttacagattaattaccatttgacatgtcagagaaccaactattttaaattacgctgaagttgaactttttatttatacatggcaatgaaccaattatttcaaattgcaagttctgaaatttagtttttatttagaataatgaggacagtaaggattgattaaattcttaaccatattatatggagactccaatattatcttataaagctgattgaaaaagctttggtaaaagcacataaatggttttatttatagctttgtaagttttaagtaaaattttaatttattctagattttatatataggaaaaagaaatatatatgaaaaatataaatgagaaaattatttattttttctctcatatttttacgtttccgtgactttcattctcgttttttacggtgatactgtatgtatgtgcatgaagaaactcagagatgagttgaccagagcgctaatagaggcaaatgatggcaatgctaatgaaggaggagcaatgtcatttaacgagcttgtgaaagtgtttgcgttaaaacaagacctcaaggcatttgctttcaagaccaaagccatggtacacacaaaatttactgattatttacgttgttaataatgtgcttttgcttgttaattactcttaggatatagtacaatgtctgacgtgtcattttaatttatgttgatatatatgtagctgtcacaaatggaacgtgaggtgcaatcagcaagaaagaaggagtcacttaattggcatatagcttcacacggtgttcctcaaagtctgcattgtctttgtttgaagttggctgaagaatacgctgtaaatgccatggcacgatctcgtctaccttctccagaacatatctctcgcctagttgatcccacctttcaccacattgttctcctaaccgacaacgtccttgcagcttctgtggttgtaacctccactgttgaaaattcagccaaccctggaagactagtctttcacgttgttactgacaagaaaacttatactccaatgcatacttggtttgccatcaactctattaactcagcagttgtacaagttagagggttacaccaatatgattggtctacagaagtgaacgctggtgttagagagatgcaggaagcaaatcagttaatttggaagcactacgacaacaactataaagaaaaggagcttgaccatagtgaagagcataacagatattttcaagctttaaagcccagcagcctttctttgttgaatcatcttcgcatctatatccctgaggtaatacatgttagttttttctttattctttagctagccctaatgctaagattgatcaaggttttaaaaaatagtagacaaccacaatttcaaagttggaaggattttgtggtgtttgcaactgcaatgagattacaatcatgactgcatcagttcgcaatttcctgtgagaacaatgctgataatactctctttgttactatttttctaatattttctttataattgaccgaaatttattgacaattttgttttgagtttaacatttcatttaataactgcttttcatgatttagaaataagactcaccaaattaaaattgataattattccacttttcctgtaatatcaaggaactaaactaaactataggactgtaatttaaaaccttgaataagattttagtaacaacaagacgaatgctcagtgataattcatgattgtttcataatctgattttttgtggaccatcacagctgtttccagatctaaacaaggtagtattgctggatgatgatgttgtagtacaacatgacatatcttctttgtgggaactagatcttaatggaaaagtcagtggttcagtgttcaagtcatggtgtgagaacagttgctgccctggaaacaaatacgtcaactttttgaatttttcacatcctatcatatcatccaactttgatggtgataagtgtgcatggctctttggcgtgaatatatttgatcttgaagcttggaggagatcagatattactaagacctatcatcaatggttgaaacttgtaagtatattttgatgaacaaaaggaagttattaggcaactgcatttctatttaaaatgtgttttgacaaatttccatatgcttcaaaatggtactagcaagataatgctttaacttcacatttttacttcttaattcgggtgtctcatcattcttaatgaacaacaacacgagtgatttgaaatgttcattaaatcttttattagtttgtatggactttgagaaatatcaagcaagtattataatgtcttagttaaatataatgcgctactagctagacacctaaagagaaatagagatataagagaaaaatgtgtagatatgtgatgcatgtggtatatcagtgacaagactgataaaaaaaattaatatttttatcactttatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatctttcggtcttgattaaaacatacttcatatttattaaaaaataataattaattaatttcattaaattatgttatttttaattaaaaaataaattttttttctaaatttttttttattgaaacttgatattaaacatgaaaaatatgaaatacattttagagataatcttattaaataagatatatataattaaaatttgtttatatttgaaataaaaaaataaagaatttgtagtgcttgtatttaagatcctaggaagtatatacattatgtaggtgtgcatctatcattagtcatcttataattgagagagagaaataataattgcccactatattcaattctttatcatggagggtgctgttttcttctgtcttgtgaattctgatgatcatactaattaactgcatgtatacttgtatgatttgaaatttgacatagaacgtccagtctgggttgacattatggaatcctggagtgcttccacctgccttgattgcttttgcgggtcaagtgcaccccatagattcatcatggttcgtcactgatttgggttatcgccatcgatcagaagaaattagcaatagcatagagagtgtggaagctgctgctgttgttcatttcaacggcccagcaaagccgtggcttgaaattggcttacctgaggttcgaattttatggactagatatgtaaatttctccgataagtttattagcaaatgtaggattatagtgtgaagcgacaaagctattccacctccaatatggagatagaatcaatgataccgtatgggataagaggaaagaaggtcttgccttcagtctctgacttacggtaatgctccctgcatgtccatatatacatatatagcaaatagatgaatcaagtatacaatacgtaccctgttagaagaagctagcagtagctctacagtttaagagtatgaagatataagcatcataatccagtagtctagtaaattattttgtttttcataatggagatattgttttacttgaacagcatttgtatcttgttaattttggattttagatccttacttgcattgaatgttacagttaaattaagggttaacaaatctccgtacatattattaacccttttcggtatgattatttttaattttctagattgattctaggtatatagatgcaaaatcaattgatatagaaagcaggtgtttttaagaaggattgattctaatagtaaccgattttataaaagagtattttacattagtatacttagggtcggtccccaacaatatacaagtgtggctacagtaaaatttgagagaattttgttcactttatacgagagagctataatgttggagcctttatatatatatatatatatatatatgcgtgactttttttctttataaaaattaaaagtatattttgttttatcaatcaaaatttaagttttatttattttattctcaaatcaaccctaattatatttctctttaaatttaattatacctattgaataattaatatgaacgagaattaatcctttcctttactttaagtgcatctatataaatggatccaattattttcatgaacactagtactatatattttttatatttaattgaaatttaaataaaaataatagcaatataaattccaacgtatttaattagaggaactataaaataaaaacaaaaattaatgtgcccatagaagacactgatcaatatttaatttattttatatttgtaatatgtatctagtaataatgttttaatggtgaccgtcttaaacaataaaattgcttttggaattagtaatttttttagctttctaggtaataaaagttaattttagatgtatataccacataattttagacatatatttacaattttatcttatacatgattttttaaaagactaaattctctaaattaacttttgaaaatttatttctacataaaaataatgcttttaacatcaattatataaagtaattgtactaaaagttaaatgcgggaggagattttgagtcaaaaggccctaacaatttgatatgtgaatctttataattatgtttttgaaataagacttcctagaaaaaaacacttcaacaccaaacttttaaaataatatttacccattcacttttttggttatgatgggtaacaaagtaacaaaataataactcaattaaaataagagatgaaaaaagagtatatgagatcataatgagtgaaaagaattttactaattaagtgaaagaaagtacaacatttctctctctgaacacaagaaaagcacattgacactctaccaaagaggaaaatactactactaaaagaacggagaaactattttttttcatttttttttctctaagtagactaaataaataaaggaagaagagaaatgattttgggatgtgaacaaagggtccaccaagccttcttttatggctttggagtgcaagctaaaagcaaagctcactatgtgggactttgtccctaacagtttatttatattatactaccatttatcttataacatttattgtttttctatctctctttcttgtataaattttttgtcaaaatttgatatatgataacattaatcttatataacctcaaggatacaaacctttcaaaaaggaggcaaaggaacctgcacaattgattggtacaatttcagtgtgactccaacctggacaacaaggaacagacgccgttaacaaatgttgccgagtttggtcactatatatactgcaagaaattaaccgaggatttttgaagcaaaactgcttaaagatttaggacaacagggattactacttaatacaatttctgtatgtatgctggagggaatggacaggtctactatgtgattttttctctcacgtgaatgggtatattcttaagttatgttgaaatcacgcagccgaagagcttatacctaaaacacgtacctatttggataatttttctggtaattataagagaaaaaataataagtaaaaatgaaaaaatttatacacaaattaaaattaacttatatataatgttttgacaaaggttacatataagttaaaattaattttttaaagaagttaaaacaaaaagaacttactaattttcacctagggtgaattgaagttcattaagtttactttcttattttcatttctataagtgtttataaggaaatctatccgaacaatttattatggattgcgggcctaataatagaatgtggttaggctcgttaatgttttaagtttaggtatcatgttctcctaaaagtttaaacttaataaactcaaacatttctaacttattcactttgattttttatttttattttactcaacgtaagacttgcaacacaatcaaatacaatagttgtgttattcctcatatgcttgagaatcagaagttacccactgacctagcttaatcctcctctttgttgtatgtccaactttgaagttttaagcctgacttcttcaaaacaaggattttttccccaactagcggagagtgatcatggcatatgaaaaaaaatgcaattattcaggctttttgtatattcagaattatataattggggggaatataatggagaaattatatatgatgaataatgcggacgcccaattaacttttactcctcgataggtatagtgttaatattgaaataagcatttataacataaaaatacaatatgccaggactgaatagaaactatatatattgaaagatacataaacaatatcatatgatgtattggtacaagtgctgattagcttttgtcttgttctccgttgtaagaactttagcaaaggaatttctatgggcactctcattcacgaaacataggacgatgtaagggctaccacttgaaaggctgtggcataatttcaaatcacttatcagctgcatccaaaggtgagaatttaaggaagtgagaaacatatcaaaaaggttagttaatgtttgccatggggaatcatctgtcaaaatcatgaacttatggatttgtatataaaaaacacagcataaaaaggttaatacatctctttctaccaagtcatattatttattatttatacttgtctctaactttttctctttatattgcttaaaaaaaactttttctctttatatttaactatagatattaccatattggtgtccactcatcttttttctattaaaaaatttcatatacaaaaaaggaaaagggatttcaaaaaaagacttgagtgggagctatgatctttgaatctcgatcaaatgtgaaatttaccctggttgactattgaaaacaagttatagcttggctatgccatttggattggggagatgctgaataacaaatcctacattgatgacttaaaaacaagtaaaatgatatatatgtaagtcgaactatttcttatgttccaatgcacgttgaaccacaattttactgagagaaagctttggcgttcaaactgctaaagggcaatacaaacacagcctgagtcatttaagttgaacgtccactaaccactttcccacactaaaacccatgttgttattagccatttaaaaaccttatataatgccatatatggttgcatgtatataaaggattggtacaatgttgaaagcaattaagttgtttgtttcattggtcattgcccctcgagcttgttttagttttcatcaattaataattattaaaagggcattcaataacaacaacttgtaattaacagtgaaagatgagtgtacttacacaagttgaagagcagtctggtcttgacgtgaatattgattattggaatctatgagattaacagggaagaaattgcggtcatatgattgtgaaggtatggttgactcgcacacatttcccggtatcatatcctgttgccgttgttgtgctctctcgtgttcagctatctacatgcatgcatcatccaccaactatatattattaattatcattcatctcaacatacactttatatatagagtcttggagggaattaagagatgatcaccttagctctcagaaaattattatggttttgcagctctatttcctgcattttttcagcaagtataatgttcatgttagaagaaatataaatatcaggcataaatttacaagattttataattcccttcgtacgaagcaatcaagccatttttactttatttttcacgattattggaatttcttctgggtttatcccgtttcagtttcatattcttggtcctattaattgaaaatatgcatttggtttcaatatcgtaaaactttgatatattttctttagatactatatatatgcatataaatatatatatatatatatatatatgaagcaaataaattaagcagaaaataatagcatcgaaggaaatgatgaatacccgcttttgcatgaactcgatatcggcaaacaaagtttcatgctgaaagaattggagtgcgtagttagtccaaaggaatagagacattctaacttggaattttcaaaatactaactgaaattatcttaattagttgctagtttttgactaacttcttgcatatctacataaattcacaatgcctatatatttagaagcttaagatgcttcatgctgataatataatacctttctggatctaactctgcttaaacctttctccagtctactttccaggttctttaattcctttagactcagagagctaagagcttcaccaaggatgtgcctggaatgcaaaaaatcacattgaattttttcatttcaatggagaagtctgctgaataatatttttaagagaatggaacattgacctgtttagattctgaatgtctctgatttgtctttttaatttggacgcttcctgctgataaaactggtattgataaatagtgtcaaccagttagagaaaccttgtggaggagcattatgatatagcaattaatttagtgataggagaattaaaatttaactagaacacagaataaggtatatataaaacaaataattgatttttcagtgtgatgatttgaattatgtgttgagaaacatgcatgatacagtctatagagctcaagtgaagcgagaacatgaacacgagagatattaacaaaataatgtgtactattgatatatcatgagagagaaaagtaacatacttatatatatatatatatatatatatatatatatataactgaaggagaaactaactaatttaactgttatcttgttgagttaatagataactgattgctaactgtttcaacctgtatataatctatgatgttgtaaaaaataggttaaatttcgacaaatcatcctaaactcatgaaaataggttgagttgcgttatgcaattatatgttaaatttacataacttgctaactcaatgggtcaaaaggtggattcttttgtgaattattttgttggaattttattggacataattttattaatttttttgctaatgatattagcatgatattaatttttcaagaactgtgaatatatatgcatattataccaataagtgttgattttattgaactattatttattttgttattttgttgctttactttatattttttcatgatgataaattttaaacaacatttatactaagaatatttagtaagatagtattattatgataatgacaatatatttagatttttttaaagtatttatttgttttatttattggataagtctgagttaaatattatatatatatatatatataatatttatatatttaaaaacaattatggctaattcaatccaacccataatgcactaagattgggctggatcgattgtgattttcatcccattcttaaaatttgtccaatccatttttaattttatgagttgagagcagattaaattggattgaattggtttgatccattttaacattgtctagtgtgtgactcatcatacccctcaataccaaactgtcaaatattggtgaagatgtcccttgaacatttgaactcgtaaatgtcacattcaaaactaagcattagactattagagtatcctaatgataaaggattttagtggctttgagaagattgtagcttgaaataattaaccttcacgctgtaattccattaagaaaaatatgccataattttaaaacaacatttattctggaccaaattaaccaaacaagagcattttctatcatttctttgatttttttttagcttactacctgtgtattagcttcagagacagattctgcatttgtggaagcagcacatgctttcttgtacctatcgatagttcctctaacactgcaaaacaatacaacaaatagaaacataaaaatgtgataaagtacatgctaattttaccaaaacatgtacacagtgacgacttaatctgtagtttacaaattaattatgaactcatcttctttgacattaaattcttaggccaaaaagctttgagattgtaataaaaatgggtgtatctttataatttagcataaatatgtttttaatttctataaaattagtaattttgatttttgtccttataattttatttttaattttcatcctgcaaaaagttaaattgtgacattcgttaataacttatgtgttcagcggaatgtcaagtgaccctcccaggtaacaacagctagtgtctatatatatatggtacaatgtcaacatgtaatatcttaaaaaggatttctagagattaaaaaaaaaatgttttatagggaccaaaattaagatttattcatattttaaggggaaaaaatcaataattttaaattttaaagggatggaaagcaaagaaaaaaaattataagaaccaaataacatgctaattttataggaactaaaaatatatttaagctttataatttttaatttcaatgtccattggaatctatgaaattgacaaattacattacatctattacatgtaagagaaatactaggaacaaattatctaacacattctttgttattgattgaaaattattacaaattataaaattctgtgcatcttcttatctagtgaatcttacccataattataattaatattaaaagaatatgttattaatatttctctttcatataaatagctcagtgacctcttgctttaatttatttgtttaccttacagtgttaggccctctccaaatttttctattaagaacacaaaaattaacaagctagttgattgagtatggttaaatacacgaagtttcattcttttgataaagaatggtaaatcccatctgtctgaacttctctaaagttcaaatacaaagtggttatttactgagaatgcaggaagaggtcgatgttgcatcagtgggccggtgtaagtttaactttctctttaattgaaatgtccaaaacacatatataatggagagaataggtaaagaattgacgtcaggaatgggaagctttattccacaaagatgaaagcaataaaaacatatgggaaagagaactaatttgcctttagccattcttagaatctgctatcatcatgttacttttagctacttagggtaaagaaatcagaagcgcagaagcgggaataataatatctaaacactatgatatattttcttaagaaatataggagatgaggatgagaaaatgaggttgtagtttctcataaaaattgtttctctacacttctaaaaatatttatttctcctaaaagttgtttctctacacttcataattttatagttttatgcacaaaatcaaattcttgcacacgtttgccttttcatcttaattcatttgttttttgttttttgttttacgtacccaaaagaaattcaagttatttaaagtaaaattaccaaataataccctatgggctgggaaatgccctaaccatattagactttcctccattatgtaaaggacaaaatttacgaaaatgggaaacaaattgggacatccataaccctcgatatacttattagtttaaaatgatttactttatgctcaaaaagagtttataacgattactttagtaagaattttaaaaaatattgaagcattatagactaaaaatgcccttaattaattataaacaattaatcctgtgaaaattctgttgcaactttaaagaaaactgtacccattttgaatcaagagccctaatatctgatttgattgcttcttcgtgtaacctcattgtacggagataaaaatattcttaaaaagagaaactatattagtacagattatatttttgtatgtgataaaaatattatacaataaaaagatatatatatatatatatatatatatatatatatatatatatatataaagatgttataaaaaaaatatacaagtttgctatgtgaataaaagtctgaaagggttatttagtttgcagtttctgcgcatttcccactgatctatctcattagaattgaagtggtcttcctccaactttgtgtacatatgtaaaaacgaattgacgtgattgaggtgtgactaaatactaaatagtgaaaagtctgaaaccctaactcccaatcggatgagatgcttgtgttgtgtcactatacattgacaaataagtggtattaaggaggagtcaagatggaaggggctcattgagtgcatgacagctttgtgcagcagcccagacccttttaagatttggtggatgacaagtggagagagaaactcaagagagagggattggtaaagcttaacaatagcagatacaccaggaagctaagatttctcacctgcaaatctttgtaaccctaactaaagctttctcttcatttgctacatacttcatattgtttcaccttaacgtctataatttctatcgcttacacagatctgcacccttcttaacaaatcactgggaagacgcgtgatagagcaataattaagtagaagagttagaaagaatgatatatatatatatatatatacatggtgaacctagagtattcatcggtcagaagttaaaaaaactaatttttcaaagtattaatgcttgtttaaataattagcctcttttattagacattttttcatacatataaattaaaaaattaaacttttaacgacatatgattatctactaactatgcgtttcagttatatatgataccacataacaaacaaaaataatcataataagaaaaaaggtcttaaccccatatataaaacccttgttgtttctagatatggtttgtgttatttaaatggttcataagatatgaaatgagattgaaggagaggaaaagtactgtgttgaatcagtagtaaaagaatatttgaacctgttgttggcatactcatagaggcgtccacggcttgagaagacaacaagagcaacctcagcatcgcacagaacagacaattcataagccttcttgagcaacccgttacggcgtttgcagaaggtgacttgcctattcgttgtgttctcgatccgcttgatttctattttccctcttcccgttttcttctgtgaacacccttctgatattgcttcgttgggaaactccatctatggctgcaaccagagctatctagttaaaaaatttaattagcaaaaaaaaaaagtaaaacaccgaaagttggtatttaatttggagtatcacttcattaaggatgcatgaaattaattaggagaaccaaagaagaagctttggaataaaaaggtcattaaactataagctattaagcttgtccttgatatgaagataataatcaatcaaagacagaatggaaagaaacaaggggtgtgtatctagctagctaattaggttgtacctatgcaatgagaactatttgtagttctttggtgttatgcaacatgtgaggagaaaatgttgcaaaatatggaagtggggtggcctatgagacaggtatttatggacagaaaatagaccctccaactctcagtactgaaaataataatttggtagtaactccttgtgtaatgtttggaaaataaaagaaaaagggtatagtgagaaggggtttgggatttcacctgtcaactttcatgctcaatgtattaaccgttcatttttcttcgtgtatgggaaaaaggtgaggggggggacaatgaaagtgtctttttgaaagtgactttgttaatgagtggggtttcattcaattccaatgagagggacgtgaacgtaagtttgcacgcaaaaacttggaaagcttgaatttttgaagcatagctgcagggttgcttcttggattttgagttttggcattttatcctgctagaatctaatctagatttgtttccctccacttcagccccgtttctctttctctcatgcttgaaacctgagttttcaattgctcactcaacccaactcctgcattttttgaatttagacaaattaagtttggattcatgttaaatgatttagaatcaccttgaaatatcaggtaacaaaattttaaataatattcatatgtttgttttatgttaaaaaatcaattttgcatctggaattgattgaattgagaaaactttaagtgtgtggcatggtgtcagattagatgctctataatgttgaaatatcatttttagttaaataaatttttatgttttcacattaaagaattttgagttttagaattgataaaaaaaacatccaaacataaaacatataacttcaaaatcaattttaatgatacttagaaatacactaagtaatttttgtattgaatgaaaaattttataaagttttactactaatgtccatttagaataaaaaacatacaaatataaattatatcattttaaaattaattttactaaatctcatctaaacacacgtataatatttgaataagcatgtaaaattgattttaaattaaattaattttaattaaattttttttaagtaaacttatttatgtttgaatgtttgacaataagttagtagtaaagttttatataatttttcatcatagacaaaatttatctaaaattactttaatttaaaattaattttagactaaaaaataatttatcaaatatatgtgaatattgcgcactatatttacatcttaagtatttgaactaggtttattaatattatatttcataggtctttttgttgattttatacatatttctttccatttagatagcaacgtaatattgtctatttttgttaatacaatgtttcttaatttacgatattatatgaattaagtcatgattaaaaaaaaaagacaaatacttagtgtaatatcattaaattccatttccatggagtgttagtatgattcattatttttttattgcagaatttgaccaggttttatgttgacgtatttgcataggcttcaatatataccttgtattttgggtaatgggaaaatcagagttgtattctcagttgcaatttttctttcttctcgtgactttccagtatcttgttgattaaaatgacttggttaatatttaaattatcttcattaaaccttttgaatttggtgttacaatgtgttaggacacagcggtgtgacctcacatgacccttgtggagttatggtgggtacatatatagactcatcatcaggaacaaaatatatatctatgaagttaaaccattgtatttgtttttgttgtttgagtgtctacttgcatgatacgagactaatctttcaattaaagattcttatttattagtgcatgcacttctcaagtcccttcagtcggatttcgtcattaggctcagttggagctccctttgttccatgccctcgatcatgtatcgaccaaggaattcttgattaccagttcagcattctactttttgcaatgcttagttgttaagcaactttaatcactcgcccgaggatctcggaacaacagatagaatcacacactatactcttgcaaaagtatcggattgattagttctgatgcaattctataagcttaacctaaaaaaacaattacacctaatacttgaatgttcttgaattagatctccttctaagcatgatctagttaaaggaacaattaaaaattacaatttttttactataatataaacacatgttaggttgatgtaattaactaactattgtattatattgaaggaaaaaaaaaactaactattgtgtttaaaattaattaagaaattttaaataatataagcttttatggagaaaaaaaaaagatactactaaaaaataaacgttgaagttaatgacagaaaatgctaatttcataacacggttatcttcaagttttagtggcccgtttaagcccttgttttcaaatatatgaatgcagtttataaggtgtgcatgtgtaatagttaatcgaatttatttaaaataataataattatttttttttcttcagattacataattagaatcaaacttatgactgattaatcatacatatgatgatttcatcaaaaaaatcgtacctatgatacataaagagactaatctaagtagggatggcaaacgggccggcccgcaaaaaaaacggggcgtgctggcccgacccacgaaaaatgcggggcgggctggcccggcccgcttttgcaaagtgggctacaaatgctagcccgccccgctttaatgcgggccagcccgcatcaaaaatttaaaaaaaataaaaaagtcaatttaaaaaataaaatacaaaaaaattataaaaaaaatacaaatatgataattaaaaaaaatacaaagttaaataaaagtaaataatttaaaattaatgctaaataaatgatgtcatgtgataattcacaaaattataccatttgcaaatgaaatttacggttataaactgtccaaaagtgtaatatgctagtaatgaaagactatttgaaagtatcattatcataaccattttaatattaaaacttaaaagttaattatgagagtgcaaaagagtataaattaaaaaaatatacctatttcaaaatatgttaaatatatttatttaattttaatatttaatatttaaataatataggcccagcggactggtccgtcccgccccgcgtttggcccgcaattttacaggacgggccagtccggcccgcttttgatttgtgggttgatattatcaacccagcccgcatttttttgcggactaagcggaccggcccggcagaccaagctcgatttgccatccctaaacctaagttctgaaccaattaattagtcaaacattcaagtaatagatcatagatgttgggcctaaatcccgagcataacctttacgtcaatgagctacaaattttcacactagaattgaagcatattgaaatcttttcctgtgtttaaactccttttttgtttcttcttttaaccgtgtgtttctgcatttaatcaaaatttacgtgtgtcgaccgaaagttagaaattataacttctgcgtaacagactcaagttgacgtgatatttctcttgatacgtagtatatataaacatgagtgagagttttatatatcatttatgatagaaccgatgtttcacactacatctgaaataaaaaccttagtcgtttattagatctatatctaatatatatcttcatatgcacttaagtaattcgtttttcacttgtgaaatcttcactcacttaaaatagtcgtgcatttgacatatttgatgaaatttatagagctgtcaatttgagatagtccgatctatttgtattggtcaatcaaggagcatgcaaaaaaaaaaatggtttagctagggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctctataataatttgtgttttactctcagataagacagtggtttagatgatatatatgttcgggtaattgtataagttattattaagtttaaatttttgtacataaaaaagaatttaaatatgaataaattattaaaaggaccaaacctggtgagaatgtttcattacaaagtaaaaataatttaattacggcggtttaaaaaaatggatatactgttcatccttgctcccaaaactctattaggtatagaaattattacatcttcattaatttctaagtgataggggcaggcagatattataagttattagcatacttcaacgagaatatatatgacttcgcaaataaaattgcgcatttaatcattcattatatattatatatcttttcatgtgcatatatacaattaatatttttttattaacaataataaacttaatcacttgatataacatttagtcgtacttaaaattcattattccttctttcgaatatattatgtagctacacttaaaattcattatagggattaaatttatatccttctccacaatttagcttatgttgtgaattgagctgcactcaatgcatatatatacaattaatatattctcaccatttttgaattggacagtttgaaaattaaaagcacagataaaagaagtagaagaagaaaaaaaaaaactcttcattagtttaaactactttgattagtcttacttaaatgtctttcacaaagaaaaaagaaaacgattttgcaagatcacaccatctaattcattcactgatgaatatattaggaccctctttgcaaacaatttctgtttcagatatcaaatatcatggaaaaataaaagggccgatggaaattaatgtaacttcaataacataactaaataagcacatcgttgagatatgaatgataaaagttatctaccagtactacttccatttggtagtatgctatagaagtaactcaaagaaagagtaggcaatataatttgctcaaagaaaataagcatagtaattaattatctatatttcccaacttttcttctgtctgcctgctgccattgattcgtgagtataagatgatctaaaatgtatcatcaaatttgtctcatgtaaaatccactgaagatgcggaccagacaaaggaaatctttctcaattcctaatgccctatgtattttatcaaatgcaatgagtttcttcttctttttttctcataaaaaaattagattaattgaggnnnnnnnnnncatacacatcgcttactaataaaaatctgatgatcgaactcaaatcacaatagtgtgaacgaaacactcgagtagaagttttggtaatgcaataatgagtttcttttaggtacaatgtaaactaatattgtatttcgggaacgcctatagcttgccagtaactagtgccatctaataatttcataggcatattcatcgatttagttagctgcagtgtgaatggtccctagccattatttagatttcattctctagcaacatatatttaattctataccattgttttgttgaaccttacaaattcaaattttccccatgcatatgccatctgttctgaacaatttaatgccaatattaaggctacattctatgtcctagcctcctacgtacgtgacctaacatcataaaaggaaatttgaatccttgaagcttcttctttaaggaccacgttgttctaacatggaaagggttttgataataacccattgataagtgcaattattccttcataccaactcataatcatggtgtctgaaatttgggcatacaatcatctttttcttgacaacttctgatcgatcacatgagagctaattaaagttagttgttatgcatttatatgaccattcaacacttacaactacgacaattaacaggtatttccaagagaaaaataatttccaatacttgctaatataaatcagaaggtctatgaaagcataaacacttggtgattaaattagttagaaggtaagaccatcacgtagtagttttaaacgtgaaaaattaccccaagtattttatcatgttagctacgagcaagtaataatgtttgataaagtaaattaacatttgatgggtctgtttggatgttagcttctctagaagcacttctagaagaaaaaagtatgaagaaaaaaatgaaatgagctttttcataagctaaaataagtatttcattaactaatttgtagatgtcatctcatcttttagagaagttacattggtgagcttctacaaattagctaatggaaaacttatttttacttatggagaaactcatctcatctttttgttcttatttttttcttctaaaagtgcttctagagaagcttacccaaacatgtccgatatcccttacgactgaataagtgataagctaggaaaagaagaaagataaataattagtgataagatgtgacaaaaatgagagacgcttgaatatagtgggtgtctaaacataaacaacaatagtatttacgcctttctctcagttctctaattttctttttaggtgtcaattatgactcaagtctccatggatatttttccgaccaagtattatcttttatggattgatgacgacatgaaaaccaattctttatactcgcattagaaaaagaaaaaagatcaggaacaaggattttttgaggtgggacagagtgaagaatgtaggacaagaacaaggattgaaacacatacacgtcatttctacacttcaactatgattgctgagaatctttcatgtgctgaaaatcgtttacttgcgttgaacactgattcctagagatgctagttatttccttgcaaagcctcacattatttcagtaaccatccatacattgtattggatgtataccaaaatcttgcttcaatgtgaatgggaatgtacttgactcaaatgcctttgacaattttctggccaaaaaactagttacttcttgtacgttgaataatacattcaacaaactgctcaccaaataagaagttaatggacagagccgcagaggaataatttgatcatcatcggtaaattttatcacacaatttttttaaagtcagcgcttacggagtagattcaatcttattgatgattgtggatttttaaatttaagacaattgaggattgaacatgctagacatgctgccacaatacaattatacaagttttgccagaaacgaggttgttgcctttatttgactatttgagtacaccaaaaaacttgaacttcttttacaaatttcatcatgcatatatagttgcagcaggacaatgataattgagcaggctacttctaagtggattacaaataagttagtaccgactaaaaggagtaaaactgtatcactcctatcgaatcacaccaaaatgaaatagatcaagatgttgtgtagatatgagattatacagttgatgatgaattaattaaatttaattgatattgtctataccaacaagatatatctatttttcagtagtctgtcacttaagaatttcacagttaaacgtgtttgacttgaaatagttatgggaggaatgaccttctaataagttttccgaaaagcgtatgagtaaggacaaagcatgctgaatagtgttgtgttgatatgcagcgacagtcattgatactcaaagcaatcaaagtatattgtcgaggttccgaaaagaactatacacgaaaggttataatcaatggaatgttatagtgttctaagccgtcgagaaatccacaattaaaaatattataataacaaatacaagtaaaacatgtaagtagtggactacttactattcaaatataagaacagtaaaatcctatgatgatgataatagaagtaatagaactgagagaaccatatcactgaaggttctaagagagaatatataatagggaaaaactttggaactatctatgaaagttagtaaaatggaaacagggcacaacaataaaattgtatcccgaacagaagaggcacatatgcgtctgataagcccaatggagaaaacaaagttgacaaagaaaaataggataatatgttaagaatggctagtaaaagtaagtcagaaaaaaaaatgctttacccgaatttgttgtcttccaattgccctacatcgtctactccggtaattcatagtcatgccaatgaatacataatgtatggaccacaccagaacagcaatattgtgatcatagttaacagctgtgatttgtgaagcacaagtcaaaattactaaaacactagtagccaattgatgattgattaggtgagggaccacgactaaaaaatacaacgtaaggagttgaagcaggacaattaattcattgttgaaaatctcattacaaagaaatcaacactctggcatgggtggaatgattttgtaggaaacaaaaaaatgtgtaccgtgtacgtgcgagacgaaacaacttgttaacgtcatttaaatattatccttttgcatttgctttgaattgattaaccatggaattagttgggggtatacttgcaacattgcaaccctcattcttcgttctttttgttggttgggatcataaaaggaaaggaaaataaataactttttctatccaatccctcattttttctttgtgtagcttatcgtcattggtcacgaccaaagatattttcgtgatctttaaaaaaaaaaatcaattcatcaaccttaataggatatgtttgactgtcaacacggaaagatccataataatctacaaatcaaactacatacaacgaacaaatttgtattgacaaacagtggacatgacttttgctctatttctaatattctatggatacacacaacaaaaatgatttattaaaaatataccagtataatttactattaaatttatatgtttatcaaataatttcaagaaacggaaataaacttcttttatcttcataatacttgtttgatatttaaatatttaaacaatactccatctggtccttattactataaaacattttggacatcaattatacaaaccaataaaattaattaattcaattgattctattgaatttatataaaaaaaatactactaatgtgtcaattatgtccttattaacaatcattaacttgttatggatgatgtgaaaacattaaaatgctagagtattatacatcactatcaataaaaaacataaatacttaaaagacaaatattaaacatatgtctttggaatattggttaagaaactaaaataaaataaaatgatatcctatgttttacataataaatacttactcattttaatttattaatcaatgttacgagaacactaattaacaagactcataattagaatatttgataagatcaaccaatgaaagaaaaattaaatattttataaaaattctaaaatctcttataaaaagtatcattcattttttcttaaagtatctcttatgataaaggagtagagtgagtaaaattgatgtgaattaaatgtgttggctaaagggcttattttccattgtttataagagtatgagctaggtttaagtggcccaataatattatgctctgaaaccaaaaaatggaggcccaataatgagcaggttttccaccgcgcctccgtgactccttcctccttttgagtttcattacattgttcgttgggcccaccaaaagcactcaaaatttcaaccatgctgcaacccttacttcaagatgcactcttcgtaagtccttacttttttattctgcttcaattcatcccctgtgtttgctccttgtttttcataaaagccttcagtttatagctattgagctctcttttttttctgatgaaaaaattgcgctttataatagtcaatctgaagttgtgaaatttcacatattaagctttgtgtaaatcggtaggccaacgtatgcattgcattcattatgtcatggatagatcccctcacatttttattgacatgatatatatatatggtgggagggaatccacttatatatagagagagtggggaaggaaaaaggagatctcaagttattataaaaaaaaaaatttaaaagaattattttttattctaatcatttattttcttaaaatctaataattattataactctaaaagatttactctatattccatgttgatgaggtgatttttgcatggtgaagtagtaattaacttgctttggtttcatgcatgtgctgaaaaccaaactagtggaccgttctttgcttggtggattaaggaataacaacttatctgtcttattaacatcgcatgagatagcatccagcaatttcttatctcaggtcagtttatgaattatggcaatatcatagttgtgaaaattgtgatcatgagtgatatttttaaggacaatacttgtcaagttttttaggtgttttacttttttatgctgtcattcaattagaatcagtttcacttccgtaatctactcgtagtaagttttgcattaaaggattacacggattatcaagataaaactccaattctaatgggagaacagcgcatcgcgaacaatatctaaggaactatatatgtaagttttgtcctattttcagtgacatgttatttatttttcttacctttgctaaacttagtcatttgaagttgtagacaaccttgtaatgcaaagatgccagacatggattagtgactgactgactaatgaaaaaaattgttttgctttagcagcaacagcaacgcaagttcatacagatgggaacggttctgaaggtggttgataactcatgagcgatgtgcattcaagaattgaaagggaagaagggggcaaggttaggtgacaccataataacatcaatgaaggaggcacatccgaatggaaaagtgaagaaagaaaaggtagtgtatggtgtggttgtgcgtgcggccatgcatgcaaaaggggaaggtgtgatgaaagtgaggtcaagtttgatgacaatgctgtggtgcttgtggacaagcatggccaacccattgggactagagtttttgggcagaagaagcatgtcaagattcttactttggctggccatattgcttgaatcagcttagattttcttaattttggaatcaccccttcactttttctgattgaatcttttggaatttgtgtgtaaaatgtactaactgtaacttgaattgatcgggctctattaggcaaaagagaaaaacgggagtgtacaattcatgtcatcactttagggaaaagagaaaaacagatctattggaatttttacccttgaaataacaagtagcaagtagcaagcaaatgggatacaatattcttgtttgcttcttgtgtggaggagttattatgttcatgattgcatttgagaaactttttttcatagatgtataggtgtgttattttccttttagttatattaaatcgtcttgcctgattatatacgaagttaattttgtaaaattagagtcaatccgatgatcaaatgatcagtgcctaatctttgtttttttaatggaaccgtgagtggataaaaattactaataacgtattaacgttattcaaacatgaaatttcaatactcttttaactttttttctccctttttttcttatctatatagaaaatgttttacatagatacaagttgttgggatcattcatgacaaaagtccaatacccttgctctattaaacaatttttttgtataatatgaattttataaattaaactattaaaaattcgtttatatacaatattatagtatttatttatattttaaaaaaatattatagtttaaatgaaattttttgattaagtattagttaatttttaaattctgcaatttattttataaacttgacgtgtttaataagatcaatttatagtaataaaattagcattcaaaaagaggtattgaatgcaataagctggaaaccataccaaaaaaataaaataaaaaatcatgataccgtgaaagaatttaattctgaccattattaaaatggattatcaagattaaatttaagtcaaataatcctaaccacctactatatacttatggtcaacatgttacctctcatttctcactttcccattagatagttgtatatatttttttaatagaagataattttcgtataatgataataatgaaatttgaatttgtcatcttctacaaattattcaaactccttttcactaacaagatcctagtgactcaaagcacgttcttgatatcgttcaatcttattaattttaacattttatttgtttgcttgaaatcttattttaacatttgacgtactatattaataaaccgaagagatatcaaattgtattaaataatgtgacaggacaacattaagtacaagtacaaaacttttttatactgacattacactaaagaggaaattaaaatcatgtatacatagacacatatttcagaaaattaagaagagagaaaaagtagattctctcgggaccctaatactattaatgtagggtttcaattaaattgaatttgatgggtactattttgtcctatatactaaaggcttaaggccgtagtagtagtactttttacgcaactctaccgagactgggagaaacaattgaaagggtaggcaccttggtaacatttaatgccacaacgacaaaagcttagagctcaaaaggtaatacgataactctcgaatatgcaccaaaggcacatgaaatcccaaagttttggcatccttatattcccctcccgttttgttacacatatagtataccttaatctttatggtctctttcctttcttgagagaaaaagaagacttttgggtcattccacaaacattcttttcctttccttcattcatctgctactacactaaatatatacatctttgcatgcatcaataatacaacccatattccttcaaatcttcttaaaacttgaatttccccaccaggaaatatctcaatatcgcagttcctacatcatgggtgtccttggaacaatggcaagacatttggacacaataatagggtgaacaaattaatctctctccattaatttgcttttaaaaatatctgtaatttgtgtcgtatatatattttatttcattccactcctacacatgcattgctatattatatctgcgccttaacagaatatatacttttcacacaatacctgctaaatcccatgtacaaaactcatttaataaaaaaatattcaccataatatgtattctgcaatttaacacacaactgtaactataggtttttcattttatgtttttccccgtaacaattaacagccttttttttttttttgttttctgcatgccaggcctggagtgatgcttctttatcctctgtaagtatagtaaatgccatatcatattatcatgcaatcgtgtatcattttctcttcctccggattaactgctgtaattcttaattaacaatcaataaaaagaaattaattaagcatcctacgcagaggcatgcatgcacattatcttatctgtattaattattacatgatatgactaatcatcaaattcttgactacttctgagtaaatatcatagatacgcatcaatgagagcaattgaaagtccttcaaccttggatgatcaacagtggctaacgtattgggttttatactccttcatgaccctctttgagctttccactcataagatccttgcttggtacgttgacatcaatttcatgtcaaatcaaactatatatatatatatatatatatatatatatataggcacataatagtaatttaatatttgaactttgccataaaaatatatacaggtttcccatttggggatacctgaagcttatgttttgcgtctggttggtacttccaatgttcaatggagcggcttacatatatgagaattacgtgaggcaatacataaagaatattggaagttccaattattctgaggagtacaagaaggtccttcacatgatgaccttcgatgcaaggaaagcagttgaacgctataacgatagatatggccctgatgcctttgatagagtagtcagagcggtatgatacaaaacaactatgaattgcttcatcgtaaagctcatttacatatctgtgtttttaacaattttttgttaactttcatatgtgcaggctgaaaaagaagcaaagaagcgatgagtgaggaacgtcaacattgtgaaatcgatacttctttctttgtatattttaacatgaaggagacggaggaatctattgtttaattaaacgaaatggcagcgattatatgcttcatatattttatgtgtatcttccatggtttaagaatgtacgtaagggtattcgatctagtttgatatagtcattttctgatttagttaagaaacaaaaattatttggttaaattacctcagtttttcgctaaatcctttaaaccctttaacgagaattctactgcaacggttactaattggtttcctctaagttccttcagcataactattaactacacatacccacaaactcatgcttaattgggataaaaataatggaaaagcttagcttgacgatctcaaaaaccataatgctttcataagcaacctttattgggtaatactcatcttcaaacaaagcaacgtacgtaatagtcattatgtataaattaaagtggcggaaacccaatcttataataaaataaaaccagttcgatcagcctttttccttcaacactttggcatacactatatagtaacttttttatgcatatacactatattgtaacttttttatgcatatacactatatagtaactgatactgtgttgaatgaatgtttttaacagataataattaaaatcaggaagaaaataaaaattgaaacataaaatcatgcactcgtatgatgaattatcctacactcttccgattttttatgtggaaacattctaaaacgtaacaacttcaccccctccgtattttcacttttcatacaaagatgctgttggttattattttctattacttattagcatcacttccacctcagcaatacataattaagtttaaaatacaaaaaagtttggccgataatacttggagaagtatgatctacaagacagagaatcaaacaggaggatcgactgcaatactttgcctactaacttttttttggattttgataaaattttgtgtttatttcgtgttgcattaataaaataataagcgttagtgtaccggcaattaaagaatatctgacacataattagctcattttgactcaaatgaatatgaaatccgtttaaatttaataaattcatcaatgtaacatctcctttgtaattgaaattggaatgaattagtcaaattgatttatttaatatattaaaataattacaaaaacgtaattcagtttaaattctctcacaacttaagacatgaatgcaaattgaaactatttttccatcaaaagcaacttcactggattaaccttttatattcaaagcagcttgtaatcattttttttttttttagaagtttttaaatgaaaaataataattttttcataaagaatcaaagccgggatggtagaattttttttttcttcataatttgccagttcaaattaatgaggaagtatccaatggttaatgaataactaaagccccaaattcaagttttattgaataggttaagagagatggactattcccttatcctaaagcccatctttctttcctttctggggtatcagtaataagcacatctttgcatagtcattgaacagatgccatgtggggaatacctggctcaaaaatagatatccaaagcgtcattattcattggagacaaaattctgtaaagggcataaacttcaaaactgagagctggatgtatcgaaagactggatggaattatatcaatttttccacacgtttcagcaacctggcaatattgatacatggataatcctgttatgttctcaaatggatatatactatggaggaggaaaagcagatatgataaaatgatataacttacacctaaaatcagtatactttagtcaattttctctgaatttctatatcactaacactgtcagtaatcgcaggtgagaatatggcagaatagcttgtcatcctgatccatattttaagaggaatttaagatgtgctttgctcttttaggaccaagtcggacaggacctgatgttaccatgccgtccagtttaaaagaatttacagcagaataacttccaggatttagattttgtgcctcatgctgacaacacctactcctagcactgcccatgtgcggatccagttcgagtgctcttgtgtttcgttgcaattccacacttgacttttctccaggcaacctagtcatacgactgaagttttcttgcactcgtatattcggtaacttggtaggttttctggaatcatcaagattggctgcagctgcaggtctctttctggtatttgtgcacagctgatggtcatcaaacttcaatctgtcagcgaccttatttatgtttatattaccactatttatggtagagggtgtaaccggaacatgtagtggatgaccaattgatactggagaaagaggagtcgtctgcatgggacctagagaagaagtcagatgattagaaggaaagcgaacttctgctgaatgattcacaaatggcgtagtgaaattatttccccacagattttgaggaaaattttgactacttgaagcagaaaattgccgagaaaagatccctggtagcatttcatctgttgagattgacaaccacgatggtgaacttctgtagggactatcaaaccaagatgttttggcctgttcattcacagttggctgcaagaaaggaaatcctccaaaggctgattttgtaacatggggatttttgttcctgtcattcagctcaccattggctacatgagtcgagtgactaaaattgccaggtgtaggtagtaccactaattgagaactcaatcctagaggtttagctccaggtataaactgctctgaaaagtcattggatgcaccattaaatactgcataagtagacttttgagtaatgggattgaaataagaactggcatttaagttgactccatgattactttgccgaccaataaactgttgagagaatccagagtctgtactgctcatcaatatggtgccttgtgctgcttgattgctttgaaattttgcggcttgcaatacattgtcagctgatatttgtataggtgaaccagatacccaatcctgcttagaacttctttccaataaagagtgatctaaagcagcatattcagaataattccttcttctggattcctcatcaggccaaacatctcctgcaaattgttgcatctcttggctgcttctaccaattggaacatctttacccatcaacctcattgttggttggctggaacttggtgagatatgatgtgaaccttctttcagagaaatcaccccatttccattgtgattccagacccggtcacattgattctgttcaatgaacgagttttccttacagttcaactctgaattaagtggtggaacatagtgactggaacacatatctgaagaattaggtcggttgatatcttctctctctctagattgtaactcagtgacaggtaatcgggctggatgatgtggaaatggattaagactatcttttggaaatgtcttctgaacaacatgattctcattaatgcttaaattttcctggttactttgatggagaatattattaatgggtaagccactaaaagaaccacgtaacgtacttgatgtatctgactggttcatccctaagtttccacttgaactgaaattgattaggtcaccgtgagaattgagtggcaaaccaaaaaaatccggatccaaacagctatttttgccacttcctttctcccagcctgtattggggaatgagttatcaatcatatctgcagaaaacatacgagaaaattgcctacccaaggcctcgccactgttatctttatctccacaagtttgcaatggagattctggtttttcatttgcattatatgaagcagaataagatgaagaaggctccagaaatgtctttgtattttcatttgagttaacagcatcaacctgtggatcatccaagtggttgaacttcccactgtagctgaaagatccagattcacacatctgtgtatttataccagacatctgctcttcttggactgctaaaagaggtctagaaatgtcagcatacggagaacaatgcagggtatttctgttccctcggtaaaaaaactgtgaatcattattgtcacaaactgccaccttagtcaacaattctgacttctcttctaactgttttgacttctcttgattgatacatggcttcaagaagctttgtacggtatcttggtccagagtgttagaaaactgtttactttcaactatagggcaaacctcctctctcttgcctctgtcaatatggtcataatttctttttggctccaaacttgcagtttcttcatcacttccagaggacttttcctttactactgaagatgccaccacatctgaagatatcttgaacatggtttcatcaaatgaatttgtcttttttggaccaagtagatctttgccagagaatttcacatgtctgtccgaggttgcctcttgatcattataatagctttcttgagcaccatctccaatactactgccacttgacgtcttttcagaaacatgtttgaagcggttcttaagaatgccatgaaaaggagatactgctttttcttgctttccaactgagtcgcagtttttaacttgttgcttcttttctaccgataagcaatttatacctgatttctttctatcgatagaaggatcaacctcatgcagtggaagcattttattaccgattgtacctttcagttttctggaactgtttactgcactttgcaccatgcgctcgtaaacatcatcctgagatagacaagattaataaaattatgaatgttatattataataaaataagaataagctgactaaccattaggatatgcaaaatatgaagataaatataataacacctcttgtagcctgtagcttttatatctttctcctttcttttcttttttatggatgtcatgttgtagtttttataagaaaataaacaaaattacaacaacagtttcatgtataatgatgccaaaatgtatgtttatgaaacagacactgtagaaaatcagcatttcatatcctttcaacaattccaatcagaaatagtgaaaggatttcaattgtctatgactgttgctacattacaatttacaataacttgatgtccaaagatgaatgtccctaaaactttactcagaccattggtttttcagtttttttataattcttgtccctcatcaaaaagctttttgtaaaagattgaggcaacttcgttcgtgcctatatcttgtgtctacataagataaaacggcaaagacgttttcaaatggaatttatggtcaagtaaaagtagatttaatacaaaagaacaatttcacgatggaaagtttcagggaactatacaaactatatttccagcgttaattataaaatcacgatccaaacttctggataaacaaactctttgattattaagtgaaatttttttaattttctataattaggaaaagactttagtgacatttgaataacagtttaattggggttttaagtaccccatcattcatttaaaaacaaatcaaattgaaatacattaagatcaactacatgtagaagtttataaaattgaaacaattgaattaagaacgaaattatatcattattttatcatgataagaaatttcagaaacgcttaaaacaaaattcttaaacttggtcattttagtatcaattttcagaaaagggaaacatagaaatttatatatgtatatatcataaatgcatagatcatatatttaagtagccataaaataaacttaggtactaagaaaaacaattgaaatttttgtaatcaatacatcccagaaacgctcgtagttaataaatataaggttatttgagcttatatattctggtacaaatatactactatttttaaatctttacgagtgaataactgaatatacatgaaataaccatatatcaagctagatgaatgtataattatatatatgaatatcagcatgaagaatgcatgagagcttcaattcaaaatcttatttattgataatttttacgtgttgatagaaagaacaaatccctaatattgattttacttaacaaacagaacgctaaacaagcttgtagaatttggcacgaatatttttttttttaaaatttcgttgtaactgaaagctggggcgtaaaataattatatgctattaagatattaaaaatccggtaagttgcaattacactttatgataaaataaacaaaattgtaaagacaaccctttttgtaacaaaatttctaccttctacaattccactttgcgaatcttctgtttgaaatcacaagagattacttctaaaatatcatatccaaagtgtaattctataacaacatatatattcttatcattgtttatacgaagaagaagctaacgaaaacacatgcatggatatagaaaatagtattaggacaaacaactattacagattctgaaattaaacgatatcaccatgaggttaaaattattattgtaaaatatttatacgataaatatcttacttagttcgttcttttagaaaggcaatttaaaatgcaaattaattaaattaaattttaaaaattagtgggatattggattctattaaaaggggaggggatggacaatggcaaatgcatgaatcatgatgcttaaataatttttttacataaatttgagactgctatgtaattgttcactgttgaaactagaaatgcacatatcacatgatacacctctgtagaaatttacgtggtccagataaccccattcgaaacctgagatttctttagaatctgaatgccgaaaaaatccaatatattttaatcttgtaaaagaaatggtaggtaggaaaaatatagaatcggagttcgagaattatttttggaaaataaagtatttactaagactagtctagaaacgttatttcaaacaatctagacactataaaaagatgccattactgatacagtaaggacagtcaagttataaatttcacttcttaggatagagttggctgcaagatcatatcatccttatatcatcatcgagtaaccttcatggctagccaagttaaatatttgactactttacttccactttcaaatttcggccagcgtaaccacaaactgacgttggtttcggttttctattgcttctatatacacctcctaggttgggttcaaatagacactcacatcgattagatcgtatctcaaaattgtctgcacatgtccaaaacatgagtcgctaacttatgttgaccgatacatccaagtcattctacccaaaaacgaacactttcacaatataaaatcaggtgtctcacacaacgacagaaagtccaaaaccattatacgtaccatacatcaccaccccctacttcactaatacgccataaaatatgcccatgcgataatgatctatatcaacccaagccagagtattcttttttgacgatacatgcccatctggaaattgcatatgcgaacattcatcaatccaaatcactaaatatacacttctgacagacccaataaatgatctatcaaattctggacctccacttgcagatctcccacaagccaaaatacatccagctgtaagctgcgtataaaacctctctacgtccgaaaaactggccacaagagatatatgagaatctgttgatctacccatagcacatacgataatccccccccaaattattagttaatagtgacggggctagagaaacccctcatcattagactcagctctctcttctacctcgtaacccatgagtggccccttctagctagggtacttgtactgattatacacacaacacacactacagctggagcaacattcttacaggcttcactaccttctgaatcccttccgcgcacgaaggcactggtcatagttttccttttttcgtaactctcctttcccaacttttacttgtcgcgtatttcgctcaagtactcaacaaaaaaaaaaaaaaacacccactttcgtccaaaaatatgtgaagctctctctctaatcagctttttcagcagtaattttatgcagaaaaagcaagacatagagtaaggaaagctataatcccatggcataagaaactacatcaacccaaaatctacattctacagtgtcgggtaatattttatgcgcaaattccatgaatttgtatacttatcagccaggaattagctgcaaatcgcggaaacacacagcaaataacggaagattaacttatattttatgagacgcagaccacataccttgttcccagttggtccgttgttgaagacattcttttttttcttcttcttcttgctcgcaaccgtctgcttctcattgctcacgaaccacacactactatcgccgtgcttctccaccttgcttttcttcttcttcaccttcttcaactttttcttgttcctattcttcatcgtactcttcttgttcttaattaccgaagcaacgggagtagcaacagcagcagaaggagcaggagtggcggcactagttgaatctccacctgaatagccataatcggatttctcctcatcttcttcctcaacctgaatcgctttccttttgccggcttcgatcggtggcgccaccgtaagaatctccgcgatcgagcgcttcttcggcgccttaggtatgggcttgcaattaaccgtcgaccttctcatctgccgccgttcctccctgacggcctgcgcgaggcaaccgtctatgtgtgcgtttactgccgtcaccgtggcggcgttgaaatctcgacaaacaggacacaccatctccatcttctcctccgaggaatctccttggtccgatttcgccgactcgccgcctccgcgcgtggatctcagcgcctccagccgccgagaaagccactcgaacttcgtgacggtaatcgaaacatcgtccgcctcgccctcgcggaacggccagaacttcaacaccctctcgatttgcggcggcggctgaggctgcggctgtggctgtggcggatgtggctgctcctccaccttgaaaatctcggctatggaacgcttcttcggcggcttcgactttgacgacgaagatttcaaattcataatcctcatgtggcgacgctcctctctcatcgtctgcgcgaggcatccgtcgatgtgcgcgttcaccgccgtgagcgtcgcggcgttgaattcgcggcacaccggacaaaccatctccagtttctcgtcttcgttgttgttattgttgttcgccgccgaggagtcggaaggaggcgcggatttctcggattccatagattctgcagattcatcttcgctgcaatctctgtcgccgtcgtcgtcatcggttctagatacttccgcagcagaaggcggaatctccggattttgagggcggcggtcgttggaatcgccggatctagggcacaggttcatcggcggaagccacgactgaacctcgtcacgtgatacgtcacgtgaggaggtggatgcgaacggccagcacttgaaaacgtcgatggacctcatcttggatgtgtagtccctgcaacagcaacaccgaatcaaaacctataaagcgcgcttctatatattagtaaaaccaaatccacaaacaatagataatagaaaaaatagatataccttatggagaagccatcaaacgtagccgccatgataagtgattacaagaagggagagactacgaagaagaagaaaaagaagaagaagaagactgagaaaagaggaacatcgatgattatgattagatgagagagagagtaatcaacgttttgcgctctcacaccagaagagaagaaggaggaggaataggagagagtgttgtgtgtagctgtctgcttgcttttccctaatttatgactgaaagggacgtatgagagagagagagagagagacgacagatacagaagaaacgaaggtgagagaatattttattaattattaattaaactcgcattaattatttaattaacactcatgttttattataatgttaatgttggtgcttgttactgtaattgattttcgctgattaattattttattattgctaatcaactcttgcgctttattcttttctttccatgcatattattttcatcttaaaaaaaaaaaaaatgaagttattgcgaattgtgtgtgttgccttgctggtggctgctccgccgaaggttaagcgtgtatgtattaaaatgatagtatagttaaagggggcgtataatgtatattgtatggtagtatttgttaaatgctaatgttagatttgtagtatgatctatgctgttatatgcccacgctcgtctacttgtatgaaacaaagattctgctgtaagaccacaaataatccaccatacgcgatcacccaccaatccacgcgctttctaccattataatatcacttcttttttaaaaaaatatattattataaatagtttccaaattacttacattgttttcttttttttatacaattaacgctttatttttcatggttttgagttccacttaaataataagaaataaatatatataattaagaactaaaggataaatcaagtgacattatacattaaataataagtactaccttaggagaaactcaaatttcaattactacttaatctttatggttcttcctttttttaaaaagatgtgtacagataggagaaataacaaaagaaattttttttcttcttttcttctaatactttcatttttttgtgttctaaatttagatttacttttgcttcatatttcatggggaagagattataaagaaataatgagaaagagatgtgacaacagctagagtagcaaaattaaatataattttctttctttctttcttttaatattttcatttcttgagttttatgaaattatattcactttcactttgtacttgctgacgaataaatgacaaagaaacggtaagaaagaggtgtgatataggagagaacaataagagtcaatattcttttaatactttcatttctagagttttactattaatttagagtcactttttctcagtgtttggcaagaaaatggcaaaagaaacaacgagaaagaggcctaaaaatgaaatataacaacaaaagtcaatttaatatttatgaaatatgctgaaaagaaattaaaataaagtggcgggcctcaatcacatttctttccgagtaaaaaagatgaaaaatgacaaagaaacacataataattttacctagaattaattttgcatgacgacataatcttttttgtataataatttgctgccgatcgacatcttgcattgaccatgaacttataatttgtgtgtctcttattttaatccaattctcatcaacttacaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctattttgcatgacgacataatcttttttgtataataatttgctgccgatcgacatcttgcattgaccatgaacttataatttgtgtgtctcttattttaatccaattctcatcaacttacaatacatatgtctcttgttttaattcaattttcataattctctgaaaaacacaaatcccaacctctctaaaacaaaacacactcaccaccctcattaattattcaactatttgaaactattttatcacgagaaatagagtgaattttctttctttctttttggtgctataaaacatccttcttagagctgaaaaatagggaataaaaaaaaattatgtatctgaaaaataggaagaaaaacaagtaacaaattattctcattcaaatgttgaaagtttctatccttcctcgtttaattttttctcatccaaacaaaaggtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagaaaaataatatcttaaaatattctcattcaacatgagcctttgatttacaatacagaactagacttaaactgaaaacaaggaattatttgattcgtttataattttttaaataagttttaattttaaattaagaattaatctcatagttgtcataaaaaatcaaaaacttatatagatatttgagattccattagagaaccaaattttttaattacaatgactaaaaaacagttcaaggttagaaaataagaaataaaataaaaaagtttgttttttttttttaattttaaaaataattaataaaaattaccaccgtatcataaaaaaatttataaatgatcaattttgtctttgtactttatattctccatgtaaatatatcgacaatttagtcttatagtgaagtttcatctgttttcgttaatgttgagtgtcaacgtgatacatccttgatgacgtgacaaacccacgtttgtaggagatgttccacatcagtcacaatgttttggactaaaatgttagtgatttatttgttttaaaatttataaaggtaatgactattttaagtacatgagactcttctttctaatttcatgataatattttcttctagatcaacaaaatggtccccaacaaatataacttaataataaaatggttcgtgacaatattgtgaatttaaagacgcgcatgtatcatagtaaaaaaacatacataagatcagtctccagagtcccaataacattcttcaccatccatgtacatactccaacaccctttcattatttcgaacaagtcaacctttgtggtgcaacataaggttaatctttttagacattcgataaaaggaaacacacaaaataaagtcaaaagaagaagaaaatagagcatctttgtatcaataataaaatttattccctttcatacccaaaacagagcatcattgtttcagttcatcaaagcatcatcaacaaaccctaaaccctaacacatgtttaatcccttgtttgtctacaataatgaaaaaataggaagaaatctaataaaaattacagccacatggagaaatgttacaaaaacagaggttatcaataaagtccagccaaacaaaaaaaacatcttaccttacgaagttgcctttcatctttaacgcacaagaagaaatcaaacaaaaatggcaaccaccaaccaaacaccaccatttgtcgccaagtcgtcataggcatctatgatgcaaaggcaataaagagcatatcaaacttagcactcacaattcaacctctttcttacaaaatgtaaaaaggaagaggataaatggtgaattaataaaaggtaaaaacatacacatactccaattgacaatttggtccatacatacttggtccaacacatggctttcacttccaccacgtggatttgtcacgtcgtctttcatgtgccacattgccaaaaatgttaacaaaaatgaaggacatttgacagtaggactaaattgtcgatacatttaaataattgtagactaaattgattattttcatagtacaaaaactaaattgacagttagtgtaaagtacaaagaccaaattggtcacttaccctaaaaaaaagtagttatacatgaattactcataattttgaacactctatcaacgcctctaatttctcttcatctttatctttttatgacatcataaatcttatcatacatatatttgtttcctctccctagatattgggtagcatattattattaggtgtctagaaaacattttccttaaaaaaatttattttcgaaaagctataaaaactatttttacttatcaaaaatagttatgaaacaagaaagtccacatctatgggtaaatgaccaatttggtccctctgaaagatgcatccgatgataatttgatccttgaaatatgaaataaccaatttagtccacaaatgtgcaaatgttgtaacaagttggtccgaccatcaagtctttattgtttccattaacctttgtgcacacatgacacgaatgtaactaacgtggcacctccacaaggtcaagggacgagacacgtcttatgcacaccgttttggacgaaaatgtcacctagggcttggtgggggcaaggttggcaatgacctcgtcgctagcctcgagtatctctgacgacaattaaaaggcaacgttggagaagacattgatgctagcttggtgcttgagggaatcgacctcgacagagggccaggtttcaacgtcgaggatcttgttctcaatgtcgatggcagagtggatcatcttggtgtgctcgttgtgcatggttgcaagtatagtgacaaggtaagtgttgctaacgctatggaggacgattgtgagggccatgaagatcttagtgtacttgcggccaagcttctctagcgtgacatcaacgctgcgacaggtcataatgacaatgcagccaacctcgttgcattaaagacattgacagagttctgttggtctgtgacagtgatgtcgatgacgtaagtgtagttcacaaggtggactaatttgtcactaaatgtttgacttatggaggtgtgctttgaggaatcaaacattaattgtcaatttggtccaaaataagatgctttgaaaagttaaatattatgtgataatttagtccaaaataatatgtatctgacgtgtcttaacacttgatcttatgaaggtgccatgcgtacacgaggattaacaaaaacataaaagacctaatgactgaatcaaattatcataatatttatacatttataaattaaattagttatttctatctttttatctcttattactattttttttctaacgttgtagatactattcttgagaactgaaaagacgtggaatggaagtatcgtgaagcgcgtgaaagggacgagttgtgtggtgtcgtgtgtggcgatgcttagaatatgaggcgcccccactaacacacacacacacacacagtcacacagtttcttgcagcgcgcatcattttgactttaagaccttttgtttgtttgaactttaaagtaacgtacaccgcaaattaccaacttctccaacacagggtctttatctttagcatgtttagaccaaaccataggatgcagccaaacactctcagatttaatttaggtagatagagtttttattttttttttccaagataaatatgttagataaaattatagttgggtgatagtaaatataactttaaatatcaattataatgtgatctaaaagtaaactattattattacataaaagttataatttataaaccatattgaatccaaaatatttcatgatttgtgaacactcaatcatgcataaattttaagaattaatagtataaagaacttctgtattagtattcaacggcaataaattaacatatatgataaattgttaattttaataagtatcttaaaaagttatatttataataattttctaattgattgatgatgtaatttttttataatattataagtattatttgtaggaagtaattttattcgagttaaataaaatttaataattatttttgaatatttaatttaattacaattgcataactaaaatttaaatttaattttttaattaaactaaaataattctgtccattaattcacgtgttaaataatattaaatttaatatttagattttatttgagagttttataattatgtattgataaagttaaatattattaatcatttaactttatcacatatcactgttattataaattttaaaataattatgataaaaagtaggaactattattttacatgataatttataaatttttatttgaatataattactgtgaagaatatagttggggcgtggcaatctggcataatgatacacgaagtgactgaaaacatcatagatgcatgcggtcaaagaaaacgacaagaaggtaggacccacccactaatgataatggtattcgtgtcgtgtagtgcacagattattctctttctctctaattctaatctaatctcactttggtagtttggtttcgtttgcatcatgcctagcttccaattccaacacccaaatgcaattttcagttcttacctctctgcttccctctacactcccgaatcctcctcactcatctggtatgtgcctataatcattataatatataatttcatcaaattagtctttattctagtttggaaagtcttccatgcattttctattttatatatttctatttctttagcatatataacttactgatatcatgattcatgatatatattttttgttactcattttattatgatacctgccccaatccttaatcaagggatcatttcagtaaagaaaatgaaatataatttaatattcggctggagtatggacttggtgataaaaatatatatggacttgctgttttagctcagcactttttctggaagagcttaaatttatatatattctttttcaatttttgtttgaggagtaggaagtaacacagtggtttgctgattttcattcccaaaatgagcaaagcaggtgtcaggtgtttgggttgttgaaatttgttgttatttttgaaatttcaatcatattttggatattttttcagttgatttttttttttcctttctcttccaatgatgttttttttttcctgtaacagattgaggatcagattcaagtgcatcttattgttgaaatcatttcctgtttgctgatcctggctgatgaagaagttggaggagattgatattcaacctttgaaggttgttgaaacagaatctacagtccaagcaggcaagcaccctccaagagaattgaaggtccccaagtcactgttaattgaaacctccaaaaccaagtccgaggatcaaacaactgcaacacaatatacagcaagaaggtaacaagaaattccaactagacctccatcatgagtatggaatattttactgaaattgttttatgcattcaaatgggggatattagaggagtgttagcaatacactctctattccctatacgatggttaatttatggttaattaatgaaaactacaaaattatgattgaggcagatgagcaaagttttgtgagttttgaattaattttaatccataataaagagtatattcaaaagagtctgttactgacagacatttctcactataaatataagtcacaaatgaaatgcatgagattaagtttgcttcagacaggaacaagaaattgaaaaatgattggcatttatttattgaggcaatgctagattttttctgaagctcttcggggatcataattcataagtaaaccatgttgtcattccaaccagaaagaaaagaatcaaaagatgaaggagatggttgctgtttgctttgataattgaatgaacaattaatgcaagagaggcattgagtaggatagcaatcatggaagagctaccctttaggtttgtgtgaaagcagaaggatttagatacaacttgagtgttgttcaccatttatttaatgttccatccaggatgtacaatgacaaccagcaagggaacagttttaaaatttacataaataaaaacataagaaagggcttattatctcttatgtaaattaccttgcaaaatgtaagccttactactgattgttggactgaacgtggatgcaaaatctgaatttaattatatgtgcatcatttccccctttatagataaagaagtacacagtccacaagaggattatgatgaatttgttacctactgagtattgacaaaaggagggggtgactcttaagttaatttgactatagaaatatagtgagattaaaaatttgactaattgtacaaagatgaaaagcaaatcacttgtgtctggggtgttcaaataaggtggaattccaccttgatgttagagtttgcttttaaattacaaacaacattttagagacttgaagatactaatgagaactatttgtttgagttttaggtgtaaaaggatcttccagagatctagttattgatgattgatgacattaaatccatggatatagcaaaatgaaacgaaagcatgagaactattaattggggaaacttaattagttacttaatgctatttgtttataccaagtttttgtgggaccaaagatataaaataaactttgttgagtttctttaatttgctaacggtatggttttgaactgcaaaagcattgacttccaattaaagtgaaagaaacattaaccttgttgtttgagcattatttcttttattgtgaggtagtagctcaaaaactgaatgcttatgagttttagttttgttaactccttggcaagtgtaccaattcgtctgagtagtagtaaaacggtaagaccgagtgtcagaatccacatagactttaactgtactcagagtttgtatatatctaattttaagttaataaatgactaaactatatacttgtcaagtgataatgcagaaatgcaaaattcaaccataaataaagataacaaggtagagcacacgcaagagacataaaaacaaacacttggaggtgtaaactgtcgtttggtgcagatttttgtggacgtgtttggtgttcgacctaccgaaactactcatgatgtaatgttagagatttttcaccatttaacgttattccgactattacctttatcctctaaattaccctaaccatgtttcctcatgtaaaatagcctaaattacctaattttactcctaatcccttaagaactacatcaaataatttgttttaagaataaagatgcataattaaggctaaataacaccattttatccctaaacatggattacctagaagttccttcaagttcttagggtgcaaacatttcccaatgattaaaaccctataacatacatgtgaatgggtgatcaaatcataaacaagacaataaactcacaaaagaagcaataatattaaaatagcataaaatggttagtaaagattatcacatcaagagtgtttggttgcctagcccccaacaatgggtgatttagcctctcatagtcatgagagactcacaaatacaaaatgaagcaaaggaaatagaagaagaagaaggactccaagtaagtgggttttcgttccctattgtgccttactatttgtcccttaatagtacagtgctcctcctttttattcttcaaaatgctgcacattcgtgtttttcgaaaatgaatgtgcgctaaacctgcatgtgcgcgctgagcacacatgcaaagtccaactgacttaagtgaccaagcgctaagcctccaattgcgcacttaggactcatgcacgatattggcttctcgcgctgagcgtgcactggcatgttgagcgcgatgctcaaattcttcatacatcttccattcttgtgttgatgtgtccaaaaactctacaaaatagaacaaaacattgtaaaattactaactttagcattcttaagataaaaactcaaaagaatctaaattcttatctttttaagtcaaaagaagcatcaaaagagaagaagttagataattgctattttatttaagtgcacaaactaagtatgcataacaattatcaagttcatcatgctaaggattatggagccttcaaggaagacattcatttatatatatatattggagaacaaaaatgaaaacgaaacgaagagaggaatcatctgtaagttggaatttattaattggtcgaagataaactcttacaaatatcttgtacttgttatgatagcaagggatgttcttgtcccaatttccgtgcagtggctgaggtgatcctgtcaactttttgcatgagaaaacctctgtaggtgcatgtttacagaaaatcattgagtctaattaataagggtgtaagcactcatttgtgcttaaaagttaaaactggtttttgtctatattactaccaaatgataggtaaggagagacaaggtggtagttgaaactcgtcatggtaatattataacactgtttaacactgttagttcattcttgaacagcaccaatatatataagaaataagacaggtggctttctggatcaggaaatctgatcacgctaattactcaataaacaaattgtatgttcattcacatttgtgcattatgtgttactcgatgcactaattgtaatcctgattatttagcttttataggttgaaggaaagaggttctaggctactactagtttgatgagaacagctaattgaatgagtcatgagtggttgtgcttgccggttatgatataaattgttggcatctaaacctattagatttcagtgttagtaacatagttcatgctgttaggctgtgttgctgctgcctttaattacactataaaggttttaaatttcctgctgcaggttctgattttaatttctgttgtgagattttatgtttgtagtagctcacttgctccttagaactactacaaagaagttgggttatcttttgataatattaatttggtttcacatcacattatgctttatggtatggtaaagtcatacttttattttttatttatacttttgtgaattaacagtaaattttccccttagaaaaagttacaatcttatatacatttaaaggaaatataaaagtaagttttttatgcaagagtaagagaaatgaatattgagttattgaccattggattttattatagatggttaagattagaatataaaactaacatcatttttttaaatggtcatgtgatattaagaaacttttcatcttaatcatcatatgactcagatttgctatatatgcaaacatattctgacagctagctgcaatctatctattagaaaaataagtcagacgcacgaaatgccattgaggtagctaatgatctactcaaactcttttactttgcttttgtagtataaaatttgaattggttacattaacttgtcatctatgttcgcctatgtcaactattggatctcaaacgaactttaaaacaatttccatcaattaatctacgcacttagtgatcaatagcttttcgttaattaatttaagttgtgttacttaagcattgtgtcaacccagatccgcattattcagaagcaagatgttgtagtttatgcgtcttttgggttattggatgtggtttccacagttagtacagatcacacacgtgatttcaaacacaataagtttctttgtaggtaaaaagtatattacgataaaaaaaaatatttttaataaaatatttaattgtcctaattattctcctgactcctctttatacttaagagttcaaataatgagtaattataaataaagttacaggaccatttttcctttatctaagttttaatcagtgacaaatatttttgagcatcttactattgacttttaacatttcaaaagaaaatgaaaataataacactttcactgtcagatttagaagtttattcaaactgattattttacgaagtctcaaatgataaggtgtctaaaaattggccatcaataaagctgaattgagaattaagaaaaattactggtgaaatactcatttacaataaaatgaacacctatctcttgaaaaaaaatagtataacttttgacaataaaaagtattatagttaaaacatctatgaaatagacaaaagagtgtaatttcatagagtaatttgaagtaataaaagatcaaaaagagtatttacaaaattacaaccccaggtaattaagagggagacaaaagtaactgtgctaagacagctcccgaaatggcactcaaataggaagttgtaagccaaaatgggcctacaaacaaagaggttccctcctttcaccgtacgtctttctctctttcactctccacaagacacttttcttacttacataaacaggaattcttcactttaatactattaagcatgtttaagatgtgggtgagcacatgataactaagaatgaagttaacaatttccatatacatacaaatgagacaccaaaaccgaagaaaagcaattagatatgtattagctagcttcgatatctgtctcaacctacacatccaattcacttctttgttaccacttaagtttgtttctgagccaagcttgtgttgttgtcaggtacacaaatggctcatgaacataatttagaaattaattataatatattaattaataatgaattttttttacagtgtaatttaatttaatccttggtttttagtatataattgaaaatcatcaacttttatagtaattatttcaaaaaacttatttgaataatgtctaactagttgataggaatagcatagagatcagtgtatcaaattaattaaatttttaatctctctcaaaagtggcattgtctttcttattactactaagttatattgatctttttcttttcatttgtgtacgtctggtgatcgctttaaggttcactgtttgattcagatcgtactaaagcagaatataaggttgtaacatgtaatggtgtcaggtgtgtgttgttgcagcggttattttacgtgcgatacttaagaatgaaggtaacactagtatgacaatgattggtgtttcagaaacgaggcaccgttaaatttgaaattgtagcacttttagttttaagttttaacagagaataataagaggggaaagctaggtaatgctaattttcacttcaaccctcattaagatgtagtagtatttactttatctttcatcttatttatatttttttaaaactaattcacctcagtttatctcacaatgagtggacgtatatatttatccttttcatttaaggcctaaatgaaagaatatcatatgatatgtagttttaactatcaaacaggattgatgtctccctctaggtctggttacaaatcaataaaatcacttcgtgatcaaattaactaacatctcattcaatttatttaaattacaaaagttcatctcatttagccttatactccttgtttggaaaagaagcaaattaaaataataatattgaacgtattgttttttgtgctgcctaatgcttattgtaaagtctagacagttaatttaaacaagaaaacaagagagagagagagagagagagagagagagattaagcctgtgttttgttatacatcaaatacctgagaagtggtattttcacaccaatgacatgaaagaaaaatagaagctactatttatagctcctgcttgagatcaaatactgataaacattaaaccaaacaggcagtaaggaaaaaaagaaagcaacaaaccttcagcaaataaaaattcaacttccattttcaagtacctgtatatatgtgaaagcgataaaattaaaatgacttcaatttttgagtttaatgaatatccactgttaacataaatgatatttaaattaatgtctgatgtattgatatatcattacttattatcatatcatcttttattcattaaaaaaagtacccaacgtattgagttttagtgtataacttctattatatagaatacatattttttttataagcatatagagaatacatattaattattttcaacataattaaatttttgaaaaacatcagttaatttttttaaaagaactcattgattgtccatgcctaactgcgagcaggaaagcaaacattatattgattcttcttaaattttgaatttatatattttcagatttcagatagtctgttaaaaattaattacgagcaggtaagcaaaaatactgtttgggtacaaattatagagaaaggtaatcccatcctggtattctggtagtcaaagttgtgctatgcttctgtgggggaataacttacagtggatcatgtttttgttaaatttttagcattcaaatgctaattttaaatttagaactttgtacagttaagagactaattaagttttatatatacaactcataaatttatttgagggggatcaagttatctgtcactcaaaccaaaaaccaataaatacttatgccttatgctcataacgaaatccattagtcctatttgcaacccaacctaagttgtaaaatgtactaggctcatggaatgcaaatatctaaaatgatttttctttttcaaagtttacaagtggaaagtttttaagggtctagttagacttcaatttatgaatatccttttcttctaaatttttgatgaaataagttaacaacgttatcaatttttgaattaatgataaaataaaaaattacattattattaatcataaactaacatatataataaaattgttaatttttataagattatttttaaagtgatattgaggtaatttttaattagtttccacgtgacagtataaaaatatttacattaacaatgtataaaaaaatcaaacccattaacaaataatttcttttttaaataaaaggttgaattatgaaaaaagaaatataaaaataggtaatgccaacggtcaaaatgctcttattatgtccactgtccattgtccataatgcttgtagacttgtttgcagtattgcagttgcagcagcatatggacacattttttacaaaccctcagaatggcactgaaccaacctagacattagataggtcaaagtatgcgaacatgcacaaaacattgcaaaagcagatcccggcttaaaggtgttcccagactactaaaaattatagtggaaacaacacagtctgttagaaactatataaaaaaaaaaatattaatgcctaaaaaagaagacaacgaaatttgattgcatgtaacaaaatgaccctttgtttgttattccttaaaaattctttcatcttttaagtgtaaacagtaaaaggatttaatttaattgattaaacagttattataaattttttgatatctatctttgattcaaatggataaaaaaaatatgttttgagtttttcctaaaagagacaaatggaaagacattggcagtttctatccatcaacatcgtcctgcattctgattcgcaaggttgtctgttatcagaatcattggcagcagcatcattactgaggaagaaactaggaagcaaaacattgccacttagctatattgcaaagacaattttcgttgttttaattttgcagcaaaaatcttcgtatttacaattatatttaaatagatggatgaaagcaagaaagataacataaggatcagtgttaaaaagtaaaactgttcaccggtccaaacaggtactcaattcccttgaggcccacacatagaataggagcaacgacatggtaccttctttactgaaaaagaacagcgtcttaacaaaatatgcctaaggttaaaataatattttaaaaagataaagcttagaaacgaactaactttttttataagcaagaactagaaagaatgtctttggacaaaattacacaatgatatgtcaacattcttttcagaatttattcaaccgcacgtcgagcgaaagttatttacaaaaaactatatatatgacgtgcaagtatatgatactgcatgatcaaaaaatttattggttcttgatggcaaggcaaatatttatctggccgtaaagcgagatgatcggctacttggatttgtgcgattacccctaaatatggcttccagattctggaagcatccaggagtcctaacctgtgtatcataacaagaaaatattacaccttaggaaacaaagaatcacacagtctggttgtaaaataagtatatcaaacaatatccacacctttgagggcattctactggtgagatggattaaaaacagtcactctagtaacattaagttggtataaaaattattaatatccatccaatgatacagaaaaagtctttgaatctgaaattcctcacattctgttaagttttagtattaaaaattactgcgaagttatatactaccataactaggtctaaaaattgataaaagaaatattcacatgaaaaagggataccttccagcccctcttttgagcaagattgtagtatatgtcttccaatctcccaattatttgcctaaatgttggccttctgtacggtttttcatcccagcattcctcaattaacctatggacaaatcaaatttcctgaatgtgaaaaacttattaatttaatttcctacttgtggtaggttttgaaactaaacattcaaatctgctgccaattaaatgtatttaaaaccctcactgttttagcccattagcataaagctttggtgaagctctaaacggtggacgctcattttcaacatatgctttaggaacttcattttctggctttgcataaaacggtggacaaccttcaatcatctagaggaacagaaaatcatggaagttcctgtcaatatttagctgggcatctctacaaataacaacccacagttggttgtcaatctgtatattctatatacaaaattgcccatcatccacaaataaaataatcatattttgaactttcagaaaatgaacattttgtcttcacataaaaaaaagtacgagaacatattggtaccacaacaaactgttgggcatggcatcttactaaaatgatcatgaatatatacatatatacaaacatttatattttttgggtcaatatgtggagaactcaaaatctctagaactctacctgtccattagatcaaccttaaaatatgccataaagcattgtatatcacaattatatataatatacatatctttaggattatctgatggacaaagcaggcagagctcacgtcacgaatgcttgagctgtccatagactcctatacgtatttacttgacaagtgaaagaggaatgctgaaggaatttgaatgccaaaagcaacataggatacacagcaacaaatgatacacctctcaatgcattccttttcctgaacttccaattttttaactaacatgaacaacagagatgtatgtatgtaggggatatgactttatgttcaggattatgtaaatgcttttaattgctcaaaatataactgaaaaagcacagaaaacataaagtaaattccctttttcttttaacaaagcaaatgcaattaacagccttttaaaagttttatgtgatgagataaacagaaattacaagggacggagagtattgaattaggaaaatcagcatgcatatagaataaattcaatgatttacctcctgtaatatcagagcaaatgaaaatacatccacttttgtgccgtattcctcgtttctatatacctctggagcaacataacgccctgttacagatttgaataaattcatcaatacaaactttgaaatcagaaccaatcacaataggattaaaataaaaccagttatacatataagagatggccatatttataaatcaattgataaattcaaattagtaaaattgagcaccagctgacaactgtctttggtagtcactgagtagacagcatttcttttttccttgcagaatatgcaacacagtgcacattacggccctcatgaaataaaagttcacaatattgcttttatgcagactgacatgattgacaacgaatattacaaggttccactaaagatgaaaacttacatgatgtatccagggctccactaaagaagaaaacttacatgatgaatccaggcttgccacgggtttgtcttctttgaccgttttagcaactttaagcaacttgctaactccaaagtctgcaactttcagatgcccagaatcatcccgcagtatatttctgttgtcttactcatgtacaatgaagaaactttaaacagttccaaccattcaataatgaattaaaaatgcatgcttctactgaaaaatccatgatacttcatacacatgctggaagaataataaaatcaacaagacaggacaggagaacataaaacatacgaaggctcaagatctctgtgtataatggcttctggtttatgttcatgcaaatagttcatacccctgcaaaatatacatatattggaattattacaaatatccaaatgaaaatttttaatataggagaaaatcttcattaattattcaacttttcaaaaaatgaaataatcaggagagcttgcttccttgcaaaccaactgaaagccagtgatgcatccataatatgaaagctcttgactgacctagcaatatcaagagcaaactttacagctgttactggtttaaatgcacctttctgcttcaagtaggcacggagatccccctaaagagatgataatccattccaaattgtcagacattacaatagtgaaaaatacaaggtatagttaaccacgttatacacacaaatagaggagatatcttcctaattatatgcacttccttattttattcaccatttcactaacataaagtgaatcccaataaacataaatggaagttctaattcagcacttatcaatactagactaaaatggttatctcttatcattacttaaaatcctacaatttagatatttataacttctagacagaacaggaacataattgtctgaccggattcagttcctctaaagtgagaaagtgagaaagtaagaatctaccaatcatcaatttgaattaaagcatttcgtatacataaccgactttatatcaattgtagataatccctcactttttcacttagagggccaaaccctgtctggcctatgcagaattgcaaataactcctgacacttcaacaattagtatcagtcccagtataacttttatcatattaagttcttaattattaattttttgtgcactccaacataatgctagatttcaagtagtcctattgaaactacgctagtcactttctttctaaagactatatccaaaacgataaatttctgaccacatattttattcagctcactattatctatgatagccattagccaactagccaatatgatttgttcataaacaccacgggcaaaataacttatcataaaaaatcttccatataaccagtgtaggaccaagactaacctggggtagatattctgtgaaaatcatcattggtgtgctttgtgttacagcacccaaaaactggactacatttggatgccttattttctcaagtaatgtaagctcatcatgaaatgcctttctgataaacagacaccaacaaacaaaatccactatgagaacaaaaattgagaactgaatatccaattgagtaattgacatgaatgaaacaacagattgcataagtagaccaacccacactttatcatcatcagtgaacaattcctccccaagtgtcttgacagcaacctgaattccacgccataatgcaatcctgaaagttccctaatattcaatataaaatatgaaacaaaaaataaatcagggtaaattgacttgagagaatatgtcaaaacaaggcaaaaggagaaatcaagttacaaaacaattgacaatatagagaaaggaaacttgaaagcttacctttgttatgcaaacactattagtaaaatcaagttcagaaggatcaatctcatactcaggtacttcacgagcattctgcacatgcatgggagccatctacaaaataaaaagtcctcagttgcaacttgatgtcataaacaacctatactaaaaggagtttagtatctatgcactgaaagtgtaaaaaaatccactgcagtgtaaaagcaatttaaaaaaaatacttttttaagaaacaaataggatttgtaaaaaatacttttttaagaagcaaataggatttgtaaaaaatacttttttaaacaaaaaacagaaaactaatactacttttttaagaaaaaaaaacagttagacaaacacatcaaaagagcagaaaactatttattttattcaaaaaagtgttctctctttaaataaacttaaacaaacgggccttaaaaatcatggtaagtgtgactcttaacgtatttattgtaaatcaaacaacctaccgtacacaacaatatggtattacgaattgtgattgaatgaaatataaaaagtttgtacagtgtcagtttatatactactttcgcttctaaaagcttgaactattaggcgaactggaattatatgtatgctcagacagcgtaaaaaaaattatatttccattcatggtaaatatgtttgactttttataataactacttaaaaaagtcataccaaaagtaatatctaattaatagacaacataaaaaatttcacaccaaaagtgcacatctatctattaatatctcgaaatgaataacatctttatttttagaggaaatgaataagatctaagaagaagagacataccgggggccttgcaccgtgtttctccaaaagcttgacaacttggtggttcttgtagtacatggcatcaactagaggctgttaaacaatccaatccagaaattagtgtcagcgagtgtagaataagagacagcgagaagagcgaaagagagtgaaattacggtgctgccccagcggtcttgtggatcgacgtgggcgcctcgtcggagcagcaagtcgacgacgtcggtgcggccctggcaggcggcgacgtggagcgcggtgcggccgtcaatgtcggtgaaattgacgtcactcccggcgtccaagagctccttaatcccgtccgagtcaccttcgttgacaagatacatcaaacggaccgccgggtccagcgactccgacgagtcgccgtcaccggcgcgctccggcgcgagggaggattggcggccgagcgagaagcgagggtggagcttcttggtttccattgcggcggcgagggttttcggtgcgagagagaatgtggattgaattgaattggattggattgaagaagggatgagaataagagagtgtgtgaatgaacattaatgtgtatgtaatgattttttggtttaattgataaaggatgggatcgggttctgtgtatgtgtcagagagtgctagttcaaatctttgacgtcaccgcctttcttactacacactccatcgaggaaggaacaacgtcggttttcggtaatgcctctctagctaacctaactaagtttttcttttttggacaactattttttctaagagtataatttaagataaaagcttagatggttaagttgactttcttacagattttttttctgatatttttccaatgttgactttctaattaatttttttaggagattctaattaaattaattgcaacgttgatgactttttttaaggatgaacgttgttaaaactgaaccttcaccgtagaacacggtggatatataataaaaaatgagaaaataattatacatattataaaatattttatacaattattaaattataattgattatctataataatttttttgaattatactaattgatcttactaaatactcataaatggctagtgacacttaaaagctctacatccttttataagaatataatattacagttatatgataataaaatttaaggattgatttgataagatgaaagagaataaaataaaagataatttgaaaataaatatttaaattaaaataatgtaatgaaggtataatacttatttatatttttgaaattttttcttcacttctcaccaattttttcacaatcaaactcattgtttatttttattcactaaatatttttttgaatatcagttgaattgaaaatgattatttaaaaaattattgaattattcttataaattattgaatttttcatagtgttgtatttttctttcttttcatatattacacatagctttaattattggttggatccatttaataactctatatgaattatcaatttttcatccctttaatcttatttttagggtgatgtgaatagatatattttttataccttttatgactttctttggtataatttgggtggaagagttaaagaagtgttttatatttagattttttttttaacatcgctagatttatgaatttttaaatggagagatgtatataaaaaaatgggacataaaatacactatttaaccaaattttaaaattttaaatatttaaaaacatggacccgttttctaccatcgggtcaaaacaggagctccgacaggttcgcagccatggatctacctagctgaagggttcaggttcgggaaaagagacgaagattttgagcgcggaaccattgccattgccgtggccatggctttcaaccatcttcgaaacctcaatcgcatctccatccaccgcattctccaccatccttttcagcctctccttaacgctactactaggttcttcgccgatgctgcttcttcaatgcctcaaccgcagcccaaacaacaaccttcgcctccatcatcatccttgaagcacaatgagctcgccaagttcgccgccatcgccgatacctggtctgctttcgaaacgaaagagagaatctgttcaatgaattaaaattaaattgcacatttttttttcatggggtggattgttgaagttgttgctacagtgtgtgtgtgtgtgtgtgtgtgtgagaatatggatgacatgtatttgccctttccttggtgtgaataggtgggattctgaaggcccctttaagccattgcatgtgatgaatccaaccagacttgctttcatccgttctgcactttgtcgacatttcaagtaatcctgctctttcatttagtccttgttacctccatttttgagtctggggtgtttattcttgaaactactttggtagaatgtccaatgctttgtgctatgttataatttgattcctttttctttttctttttttacatggaattagtgggtttaaaatataatctggttgtactgtgtcagattccaagccactgttatttatgcagtcttattaaaccaatagcacttagtgtttgctacacatacatggtaggaatttggtttaataccccttgaattaaatataatcgtataaggatgtgtaagaagatgactctaatgaagtatctgttaataaaaagtgttaactgaattattttttgacacaaaccaaatgaagaaacaagaagaaaaacaataggaaaaacggtattacggttgacaatgggtttatatttttattttgtctctaacggggttctattcaaataataattagatttcacccttgtctcaggaaggacccttatagtgctaaaccccttgaaggacttaaaattgttgatgtaggttgtggaggtggaattctttctgaggtatatcttttcttcttttttcctgtgatgtttggaaaagaccttttcctttttatcttctggcctatgataaacctatagtttggtataataagttcagagatgactatatttgttgactatattacttgttatcgtaatcctcatgcgaatctgtagcattatgatggattcggaggtgactatatttgttaggttgaatacttgaattgtggaaatctgaattatttctttggtgcatattgtcctccctctcacttatagagtattaagtttgttattgtttttttattgcaaatttgtgctcttttttgttgttattttataatttatagcaatgcttctctttttgttcttcagccactagctcgattgggagctactgtgatgggtgttgatgctgtagagaagaatatcaagattgctcaacttcatgctgtatgcttattctatatttgaatatttgaaatttgtcagtcttgtcctacaaattgattagattgctgtattctgtatattggaggaagcagttgccaacattagtaaattaaatcttcactatttgccggacaacttataatctcctgtcaacagggtttggatccagcaacttcatctattgagttctgttgcacgacagctggtacatttacaaatgttgatgcattcttttacacttttgttttacatccatttttgacgtgcatgctttaagtctgttaacatttggacactactgctgaaatgccctacttatccaaatgaatgctaatacagtttagttcacaatcttgataagaagcacaagtctgactgtcataatttcctttatctaattttctgagtggtttccatggattcagacctttgctggatagtttagagtttcaaaagttacgagatcatgatgcattggcataaaaaacttcaatattttcacttcctgttggcttgtgatttcttgtttttcttacagcttgtagttaataaccattttatgttatttatcttaacttagagtcttagaatgtatctttggctgtagaaaagtcaattttttttgctatgatcttatgtcttctcactagggtcttacattgaagaaagtttttactctatcccttgatgtttctcattatacaaggtatcatacttggacatgctaaatcgctcaagtgggtgaataagttttaacctaaaagagttgttacattacatatacttaacacttcgttcatcctctctatagttggaagaattatagttttcattggcgatgtccatccaatttctttgctaggaattaggtagcatgtttgtaaaaaattgaacgctcttggtacatcagtacatgcatgatggcttcaataatcattgtaaaagtaaaagttgcttgcattcatctagttcgtttcgaattgtccttatgtttttgggtattatgcactggattttacaactcactaacaatttttaaattgactgatcagagaagctagttgaagaaggaagaacgtttgacgcagttatggccttggaggtactttctctttcgtgccccttacctctttctggttgtgtgcttgcagattggagtgcataaatgggtgttgggatacaaaaaaaaaaaaaaaagatatgacataacatgtagcgtaaaatctttgataatagtacagtactcagtggagttgaaggacacattttgccttgcattggttcatttgctttgaatttttttgcaggtgattgagcacgtggcagatcctgcagagttctgcaaatctctgtcagcactaacagttccagatggagccactgtgatatccacaatcaatcgatccatgagagcctacgcaactgccattgttgctgcagaatacattctccactgggtattcattcttctcaactcaactccattcaacacttattttttccatcgtacattcaatcgacacattatacatatattgaactccacagcttccgagaggcacacatcaatggtccagttttctcactccagaggaacttgtcctcatcctccaacgtgccggtatcaatgtacatacgcaaaacgcattcataatttcaattgttagggattaatcatcgcattcacgtgacactttattctggttgcattgcacacacaggtggaggagatggccggattcgtctataacccggtgaaaggacagtggtctttatcagacgatatcaacgtaaatttcattgtgttcggtaccaaataaaacaacaccgaatagcatagatagataaataagatccgtgttactgttattactataattattattagtattgaatattgaaatttgttttgaatgctgaataataaacattaaagttataaccgaaagaaataaaggttaagtgtggaatcagggagaggaggggcaaagtttcctgagggtgatgattgagttaatggttgaccgtgccatatctgaaactccggtactggacatgagaatcaaggaaccaggggtgagcaaaatgggaacggacagggaaatggagaggggagtgaagtgcatgacgcagtcagattcaaaggagaggatggcgatgccgtcgtcgaagcagagaaggtccaagaatacatacttgcctttatatccctatgtgtgattttttattctggactcttaatgaagataagaaggtccaagaatacattacttgcctttatatccctatgtgtgattttttattctggactcttaatgaagataagccaaagctttagctataccaagacaaattttcttccttgttggccagtctagttttgttgtgtttgggtccctccctgtatttgattgggagaaggacaatcagttagttggttatatcaaatgtttgattcaaatggtaagtatggctaaagtttactcatcatgaagctttccaaaaagaatgcgagatagacaattgttttccatgtactcatatatcactatatcagtattagctggtttccctccacacaacatccataaagcttaacaagattgggatgttgaagtccagatatcagtcccatctcattcacaaactcacgatttccttgtttagattttgaagaaagctgctttactgctatcattgtaccatctgatagtaggccctgcatcttgaacaaggtgtatttttttttcttgcattagaattacacagttacacatattcaaactactgaagtgctgattggtctaacaaatctccattacactttaaccatcatgtacgtggataatttttctctttcattaacccacgaaggttatatatgcttgctaacgagtacaaaatacattacagaaattatgattaaattgtaagcgttaaattagaattgaatggagatatagagaccatgaagtgtgtcttctatttcaaatccagtaacaaacaaattaaccataagatggaatagctaaccaagaatggaagatcaaaataccttgtatacacaaccaaagccaccttcgccaactttattcactgcgtcaaattttttggttgcggctttgatttgtcttagtgtaaataatcccgtctgcagatctttgccctgagctctgaaaataaaaaaaacaaaatattggaaatttggattcaacaagaaagttaataactttctgtacaatatctgccacatggttcatttcatttctatctagcatataaatatatagggcaggcaagtatactctcgtatgttctcttaataagccttgactttgatgaaatggagaaatatcatcaattacaaatcttatatagaagtaaattgttgcacttctgttttatgacatctgaataaagtttgtagaaatatttatttaaacaaattgtggaagaagctcagtcaaatactgctggatacagaaaagatgatgtgttggaaacaaatggaaatatttgttctaactaaaagaattggaagaacttggtggcatattccataccattatacactggatctttgcctcctaaccatcccatcctcctcatgagaaccagctactatgccgatggccagtatatatgacataaataatttgaacttggcagcttccgagaggcacacatcgatggttcagttttctcactccagaagaacttgtcctcatcctacaacgcgccagtatcaatgtacgtgataaatcataaataatttgatttgcttggtattaatcgtcacattcacatgacactttcatttggttgcattgcacacgcatccgcccataaaatatgagttatgcataacacgatggtctttatcagacgatatcagcatgaatttcatcgcgttcggtagcaaatcaaacaacgccgaataacatagatagctagataagatacgtgttactgttattactacaattattaatgaaatttgtttagtgaatgctgaataatagaacattgaaattattataacagaaagaaagggttgagtgtggaatcagggagaggaggggcaaagtttcctgagggtgatagaggtgcgtttggattgagtcaatggttgaccgtgccatatctgaaactccggtgcgcgattaatttcgtgtttccaacggtagcgtgcttctccggacatgagaatcaaggaaccaggggggagcaaaacgggaacggaaagggaaccagagaggggagtgaagtgcatgacgcaggaagattctaaagagaggatggcgatgccgtcgtcgaagcggaggaggtcgacgtgggcgcagattccttcgccgggctggtagacgttggcgatcatctggtcgaagagaggttctctgtggaggaggtggagggggaagggggcctgggcctgggcctgggcctgggcttgggcttggacggagcggcgaatggagtgggccagaggggtggcccaagaagggaggtgttgtaggccgaagcgcatggcctggttgatggaagggtaggggaaccaattggcggcttggatggaggagagtatgtgagactggcggcgtggagagaggaagtgacggcacagccataggccattcacttctgagatggcctcccactcgctctcgctctcgctctcgctgtagccatcagaatcagattcttctgatgatgacgacccgaacacttgctccaacactgctttctcctcctccgccaccctcatcttcctttcactttctcttcccgcactcttcaattcatgccacgcgcaacttacctagctgcgccattcatactttataagcttaattaaaaactgataaatgaggttttatatttttttaagataaacatatatttttcagatcattagatctaaagacaattcaacccacaattttaacgctaacaaataaatataagactaactattctttataaatttagtttatcctatccttttactcttgttaaacaatgttacaagttaattaaataaactgtaaattaacttttaaatatcatgtcgattacaaagaattttcccactcttacttgtatgagatgctgcaataatggtggtatgccacctaaacctaaaaaatggaaacccttacttgtagttgctgttattacgctggaacaactcaaataacagtatactcatatcttttgtgatctattttttttatttagaaaccatttactctcaaacatcaatataataacttattttaatttcattcattcaatgcatgaagaaatggtttgttctcaaaatttgcaattgaagttacaccaccaacagctgctaatgtcacagcatttgtaccacttacacatgcacttagaccacttcctatccgacatgcaaatactcatatgcttgagtttcatttccaagttgagtatctccaagagtgccccagtcaagcttgatgagtttcatcctataccacgtatctaacgacctcaacttcctttaaaggggttcaacgtgttttagacatattttggatatattttgaaaagttaggcattaacgtgttttagatgtattttggatatatttttaaaaatttctattatgacattgacattgtggcatgctttggcagaagttttactactacttgggaacttggatattttatgattaatgaataacaattttatattctataaatgctcgatttagcttgatggtttacatgtatgttatcttattttatggatgattatattactggctgtatgttataatttattttgtgcattaatttatcagttaataatatttgttaaggattaatttgttgttactaagtatatatgttttggtgaaaaaattttagaatgaaattttacttatatctgttgtttcaaaaatcaatattaaaaaaatgtaataatttagtccaaaataacatgaaaaattattgtgcacatatgtacttgtcatgtgaatgaatgtgaatcatttagactatctcctataacgaagacgaaataattttaatgattagaccaaattatcgtaacattttacatttgtgaactaaataaatgattttcataatataaaagtaaaattatcaacaaatatatattttagggactaaattgagcatataccataccattaactagtgttcatggttaattaggtcctctacgaagattaataaatgataactactccgcgcttgttacatactgtaaaaaattgcaataacaagtttcttaaattttgtaatatttttctcggaagtctaaactcgtagacaagattatccgttattattagttaagagcgtatacgtctcttttagcttcagaattcctccaactccaaatcctccgtttttctctctgaattccaatagttgttgtgttctgaagagagaacatgtcaagcaattcagatgtagcagcaccgacggtgcatgctcgtggtcgtttggccatgctcgctgctcacctcctcccctctgaactcactgatcacgacgccctccgccctctctctctctccgctcagttgccgccgacgaacctccacggaactttgaccgtcgtcgacgacagaaccggcaagaagtaccagcttcaggtctccaaagaaggcactgtcaaagcttctgacctcaagaaggtaaatttcctcctcatccatgaaattttcaatttcgatctttgctttccaaggaatttccaattttgcaaactgggtctccaccaattctgctcctttcatctttgttgaattgtttgcaaagtggcttttttcctattcctagttgcatggtgaaatcttaggtgggatggtttgtgattatagtatgctgtttgtgcttacttaacattgagtttagtttttatgcatgctcaatgtaaatttacactatcaaccaataagaaaccatcttagcataaaagtcaacaaacttaacatacaagtagtctgtgattgactgaaagtaatatatacactatttactcttattagtttagttattgttatgttatgggttttattggatttgcagatatcgactgggaagaatgacaagggactcaagctttatgatcctggctatttgaacacggctcctgttcgatcagcaattagttatattgatggcgatgaggggattcttagatatagaggctaccctattgaggagttggcagagaaaagcactttcacggaagtgtcctatctcataagtgagtgttctgtttcactgcaaatgtgtgtatgaggcttctgtggcgcttgtgtatgagtagataaaacattttgactgaggattcacttaaacagattttatgttattgaagacacttgaattttgggcttagttctgcttcttgttaattatgtgcttcgatatgtatgtagcatgaattcttctgaaatttattaacttgcatctttttttctgttttcaagtgtatggaagtttgccttctgaaagtcagttagcagaatgggagtttgctatatctcagcattcggctgttccacaaggagttttggtgagattttatgctttatctaaactaactcttattgtgtttttatgttctccaaatcccatccgcccttttttgtttcagtcagtgatagcttttagatttgtaaaatgtgaacaacttccactaattgttttacttcttgaaatttagtatgccagtggtattttatattgttaaagaaatctagtagctcttgaagtgatcatataaaataaaatataaagattatgttgtttgtttctttcaatggagtttgggattattaatctaactaagtagtggtatcatcttacgtttgttttgtaggatatcatacaatctatgccccatgatgcacatcccatgggtgtgcttgttaatgccatgagtgctctttctgtttttcaccctgatgcaaatcccgctctcagagtaagtaacaaaaactgctgtcaagtcattttttgttaataagctgaatttcaatacaaatttgtacattgtctatgcttcgagtccaaaggactctggagtgaatgagggggcatattagagatttgagatactgagatataataaaactaatcttgggattccttttggatgctactttttcctgtgggttactacaatgtacttgtgaatgatactctttctctaattaggattcaacattgtttattgttattgctctgttatattcctttatccagatttgatcctttttcattatttttttataattaattcagggtcttgatatttatgactcaaagcaaataagagacaaacagataacacgagttattggaaaggtgtgcttatttggttctttcttctcctttcactgttctatctctgaaaacatgcaaattatttagttatttgaatgattctagccctggttttactgattgtatcttgtgggattttgtccactatcctcgcaaccctatgattatttgttatgtgtcctactgctttattgccatatcatattttcacccctttttatttactgcagataacaacaattgctgctgcagtttatcttagaatggcaggaaggccacctgtgcttccatccaaccacctttcttacacagagaacttcctatacatgctagattctttgtatgtatggtatttttgtgcttgatcgttaatttgaattaagacaaccttgcttttttatatttaactttgctttatagactaatggtagtttgagttttgctcatatataacaaatccatttttgtttttaaaaagaggtataattcaatcttaagtgatagaatggtagccacatactcgctgttttttagagttttaacttttaacccaatctccactgtgcatactttcagcggtaatcggtcatataaacccaatcctaggctaactcgtgcgctggacattatcttcatcctgcacgcagaacatgaaatgaattgttctacatctgctgtccgacaccttgcatcaaggtagacatcttactgcaatactacttaagcaatataaagcaaatataaaaccgtcatattgctaaactatatatcttattcttatttcagtggcgttgatgtatacactgctattgctggggctgttggagctctatatggaccacttcatggtggagctaatgaggtagctataagtagttaatgaagcagtcatgatcttttatgtattgctaggttgaacgtagtgaataaacacaaacactatactgttatttaatatgggaacatgttaatgtgaccttcaattctgcaggctgtcctcaaaatgctgagtgaaattggaactgttcagaacattccagagttcattgaaggtgtcaaagccaggtggctattacagtattactttcttctgttatctagtttttactctttcctttgttagcattgcttataccctgaaaggatagcatgatacctgctctttcagcaagcagagaaaatgatagttttagttgatatttttgtcctgcatttttcctccaggaaacgcaagctctctggttttggacatcgagtgtacaaaaactatgatcccagggcaaaggtcttaagaaaactggcagaggaagtgttttccattgtgggccgggatcctcttattgaggtgtttatccattccgtatttcctgtgtctattgtctgttatatattccttgatcttggtatgctggtcacgaggtctatgatcagggctgtgaatacagagaaaaactactacatttaaaaaatttcttcctattgttttatttaaatgtatttttgtatttttaattttgattacagaatagtatgcttagtgtgtatattgtatatgtttgtgcatacaagtttggcaccattgtgtctacatgcataatcattagatgtcttgtttggtttgaaaaaaaatagcagatcaagtcaaatgaagatcttaagacattaaaaatctctagcaacacctttcatttttcaaatttaaagtattactagggtttctggcactatttttccctgaccaggaaagtacctatgtaatttaatatagattggtcagtatatggacttcaaaagttctaacttctgtatgtaattatttgatcgttcaggtggcagttgccttggagaaggttgcactatctgatgaatatttcatcaagaggaagctatatccaaatgttgacttctactctggattaatttataggtaatccattatttcacgcagttattctaacttggaggataaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccatacaaggcttgaactaatagttttatgcaatcagggccatgggatttccaccagagtatttcactgttttatttgctatccctcgaatggctgggtacttggctcattggagagagtccttggatgatcctgatacaaagattttgagacctcaacaggttaatttctttctttaaatcattattcttgttatgattttcttgcatattaaaattatatcatgcttactgtattgtgctaatgtagctgtacttcttgtgtatcacttgttttactgggaaatggttttcaagttgtatcatggctgcattatatttcttaacagtggtactgggcaatatttgcgtaatgcattagaactgtatggtaaacttttagagccacctataactaccacactcgtcaattctacctgaagatatacaacatgataagaaacttgggagaaccacatgataaaaattagcagttgtagttggagacacggccttataactctataccagaatcccatacttccaatgtgggattcaagtcccttatcttgcaattgaatccaaacatctcatcacactttgcagcactttgattagttccaggtgaacactgcaatgtcggcatcacgatctccagtgcatgtttgcagttgagaacatggtgaaaccctctgataccaatcaataagaagtttgagagaatcacaccacaaaagttagtcattgaaattggagagtaaaaggctttataaatcctacactagaactagaaccccatatttccaatgtatgacttaagacccaataccttgcaattggatcctaacaacatgtgacgcctttcttatttcaatctcttgcctagtttcatcatatctattttatgcttcaggtttacgttggggaatggttacggcattatacaccagtcaatgtcaggactacatcaagtgatgctgacaagcttggtgaggtggccatatcaaatgcctcaaagcggcggcttgccggatccggggtatagcttacaggctcaatttagttatatgagcaagatgaccaaaaggtgatatataattctcacgaacgtaaataattctttgttgatggctttttataatccaaagttaactttgctatgatcaggatgacatgtctgcataaataatgctactggtgtcacatccatcacctaccagaagaacgatgctggtgtgctttgttaagcctttatgtgcaagtcacgtttcagtacttctactttcaaattatttgttaattgttacaagggaataataaatagataagcatagtttacatatctcatgggagcagtaaaatgtacaattgattagcaaaatgtttgtgttaaagaaataagagagttttctgtgtaccagtacaaattatttcttccccctcccccctatagttgggtgcactaataaagaaaatctgctgaaattcaattagccttttttttcctctcaatatttcatttggactacgcggctaataatctatttttttataaatattttattaaaaacattttaacaatatatcaaaagaaatgttagtaatatattcgttaacatactttattgaacactttttttatcattaattaatattttttttaaatcataaaattttgtacgtctcgctttatttaatgacttttacacataattttgcagctttagataaatttaagcaatagagactttgttagcaatcctcacatgtcaacgtaaattataactaatctttttttttaaggcaaaaataagattactgaataaccctatatttaaggcaccccaatgtgatgggaatagttccataaccatagctccaaactatgattagggattacaaagtatacaactcgtcccgccatgcacatatcatatatataatattttgtgaaaaataattatatttttatgataaaattctaagtctttaatctctaaccatatcactattagagagtgaaaaatactaaacttttaattagaatttttatttagcgattaaaatattaactttagctatcacttttttattttctttatttatgacttgagtttggacgaattaatattatgtttgcttgttttaattaaattatttttattaatttattattattattgttattaaccttatacataaataatatgcgagtcacgggtgcaggtatgaggatatataggtatcaaacatgtacgaaaataagattaaaattattacctacaagggtatgagaccgggtacgggtattatttttaaatgtatagaaactataggatcttacctagacctacctattgtaatccctaattatgacacattgacaccccaaattttgtgcgaactagcaacaagataaaactctttatattgttattaattttaatttttttttctcttttcttgcattgaatacaccacgagttttgtattaaatatgtggcattaagaaactaatttcagttgtctgatccatctgaattaacggttacaggatgatagctcttttctgtttcaacatgtgagccagaggaatcagtataaatactaggtattgatatgctatgtgttccgcttggattctgccagaagtgacttcttatactcttatgtttggaacttgaactgatagctgaatatcccggatccgaaagtagatcttgaatatcagtccaaccttcaagcatgctcacaacttgggacattgttggtctaagtgtaggagatgcattagtacataagagagccacatttagcaccaccatggcctcctcagttgaatattctgaacccaaatttggatcaatcagctccagaagactccctctctcttgcaaaacatatgcctaatgaaactcaaattttagaccaaattgatactaaaactctaaaaaagatattacaatatatatatatatatatatatatgagcaattctagacaaataactatacgttaagattaaaagtgatttaacatttgccgataaaaaactaacaactaacttttgacgataaaaaaaagtgatttaatgattacatgatcactgaaaaaagacaactttgtgatttaatcttttaaaaaaatccctctcacttgatatgcccgtatatgcatgtgtgtatgtacgaactagtaaaatcaataatccataggtcttggtaatttagtatctattgtttgtttgagcctgttatattatgcattaagataaattctacttacccaatcaagaaggtaaacaaaatcctcgtttggcctgaaatttgtattgctctttccactgacagtttccagtgcaaccaccccaaagctataaacatctgctttgtcagttaaatagccacgcattgcatactcaggagccatgtaaccactgcaaaatgaaaaaaagcatttagcattgttaaaataatggatttgactaagagtatactttacagaataaagtacatcaataaccatgggttaaatatttaatgcttgaaattataactaacttcatagtatgatacacatgcatttgatttttaccagaatctccactattgattaaaaatgggtatttttaccatgttttgatatgaaaacaagagaaatagtagcaaaatatgaacttacattgttcctgcaactcgagtgctaatgtgggttttgtcatcttcaataagttttgccaagccaaaatctgagactttagcattaaaatccttgtcgagcaatacattacttgccttaatatccctatgtatgatttttattctggactcttcatgaagataagccaaagctttagctataccaagacaaattttcttccttgttggccaatctagttttgttttgtttggatccctccctgtatgtgattgggagaaggacaatcagttggttatatcaaatgtttgattcaaatggcaagtatggctaaagttcatcaagaagcttaccaaaaagaatgcgagatagacaattgttttccatgtactcatatatcagtattagctggttgccctccacacaacatccataaagcttaacaagattgggatgttgaagtccagatatcagtcccatctcattcacaaactcacgatttccttgtttagattttgaagaaagctgctttactgctattattgtaccatctgatagtaggccctgcatcatgaacaaggtgtatttttttcttgcattagcattacacaggtacacatattcaaactactgaagtgctgattgatctaacaaatctccattacactttaaccatcatgtacgtagataatttttctctttcattaacccacgaaggttatacatgcttgctaatgagtacaaaatacattacagaaattatgattaattgtaagcgttaaattagaattgaatggagatatagagaccatgaagtgtgccttctatttcaaatcaagtaacaaataaattaaccaatggaagataaaagtaccttgtatacacaaccaaagccaccttcgccaattttattcactgcatcaaagtttttggttgctgctttgatttgtcttagtgtaaataatcccgtctgcagatctatgcccctgagctctgaaaataaaaaacaaaatattggtaatttggatttaacaagaaagtttataactttctctacaatatctgccacatagttcatttcatttctatctagcatattaatatatagggcaggcaagtatactctcgtatgttctcttaaagccttgactttggtgaaatggagaaatatcatcaattacaaatcttatatagaagttaattgttgcacttcagttttatgacatttgaataaagtttgtagaaatatttatttaaacaaattgtggaagaagctcaggcaaatagtgctggatacagaaaagatgttgtgttggaaacaaatggaaatatttgttctaactaaaagaattggaagaacttggtggcatattccatacctttatacactggatctttgcctcctaaccatcccatcctcctcatgagaaccagcaccagaagaacaaccactaaaacaccagctactatgccgatggccagtatgacataagttcttttgccatcccctgatggaggtttaaaatctgtgcaagggaaaaatatttacttttagcttttgcataaatgaagaacaaaactgatagaactggatcagataaaaggaaagaatgatgaattttattgataacagaactctagtggaggtcttgtagaggtagacattaatggtaatctttcccttttcctacaatttttaaattcataatggattatggtttcaactgcagtcttatcaagtcagataaagcactaactctaagatgcatgatatgtgacttactagggtttactgaaatagcagatactagaggtccataaactcctcttgtgggtatgccagtggttccttttccagcccagtagaagtgaatcttcaaagtatgttgggtgacagaagcattaaatatcttctcaattgacttgccagtaccaccagcttctcttcggatatcaaagtctttcagcactaaattccccttaattttaggacataataatatattcaatatacatcaatgcacaactcagtgcaaatcaattatttagcatcatttgcaaatcaagcaagtaattgttacctggatatagacgtcaaatactcgccttccaagactgttaagggacctatcattgatgaaaataatctctgcaaagtgaagcttaactgtgtaatttccatttattaggcagaggccatagtatgtgagagcaaggggagaaacacgtgctgttgtgtatagttgtgaattgagtgcagagacattaagtctagaagtattggccacaatatatggatcagagtcaatatcattgtccatgaagtttccagtgctactaagagcccaatcctggctagtgtaatataacattgcagcacccttttgttctctgtcagcttcataaatattaccactaatatttgcttcgtttccaccacaattaatgttcagggagtactgatctattgaaaaaacaatgacaaacagggttgaaaagaaagaatactcagtgtaaaatctttcaaattgtaatggtctaatggtaaaaatagacaactgcatagaaaggtaaaattcgcaaagaatgcaacatattcaatggttgtaataaaaaagaataaaatgtcattacaatcattcaatggtggtaataaaaaaggatatcaaattatcttccagtttaagtttcttagaattagtcaacctatttatttcaaataattagaaaaggaggaaattagtcttaacccttaagaaaaacagttatattcttgtttctttcctaatggacatttattccttcttacattattttgttttatttgaatttctgtacaactctgagcttaagattgttagcaaagaagtaggcagtgaacttttgcgtaaatagaatcataagcaaaatcatgttatatgactatcttaaatttttcttttggtatgaaatcatgttgagttgaaagtttctcatcaacttatttcactcaatttcaggtcacagaatttgagtcaatatttaaaccagcccatcagatcataaaagtaatttaaaagttgtagtatggtcacatacttacattggctaactgaagcagggcatggaaagttcctttttaagcatgaatgaatcttatttctgcaaccaagagagaaatttaaggttatattctagggctactaccaaaaaccaaattttacagaaaatattccaaagacaacagcttactgtgtatttacagatgaagagtagctctcaacaaggtttctggaagaaaaaaaaaaatgttgcagtgataactgataactaattgaagacaacttttactcaaagcttaaataaactaaaactttacatgctcccgcgttgacattcagttggacttgagctgtcccaggagaagttattgtcagagatatcactgtgcaccaaaatatataataaaagatgttaatctcatgttgctaaaggagtgcttatttaatttcagatgcagacatcaacagcttgaagatgccagagaacataattttaaagaccgaaccggtgatcgatccaatcaagatattggatcaatggttgaatcagtgagtcatgaattaactcacatgatccggtctttgttatttttttttaatattcattatatacaacttttaaaattgtaaaatttaatattattgaaaattattttttaacctctattgttattatattatattttttgtcatatatttcaccttttttttaaaaaaaaatctctctttctttatttctttttattatataatgtaaaatattaatttcaattgttgacagtacaagcaactttaataaatgaaatttatatgtgggatttgatatataaaaataatttgctgcgtatgtgacaaaaaacattagatcagtggttagtatagcttaagggtcctgtgagagtgtgaggcatggtttcgtgtcccagtcccttcaatgttaacctcactcatttcgttcacatgcactcggtggcgcatggtccgggttttaaatagagagtataagttatctaactatatatattttttcattttctaaatggatttgttgaaaaaaaattctcatgatggaacttaatataagacttgtcttcttgttgttgaattctaaattctctaaaacatatcaatcacacactacacagtgtatatttctagctgccttattcactgtagccactgaagcaaatattaagatgaagactgaaaattgaaacataacaattcaagtatttaacgtacatatttttgttatttgcgaggacccatcgaggtatgatccctgataatttgttcccggtaagatacctgcattatctaatacattttgtttcgtcaaaattaaaaatgaaatgtatcaataacatattttattcaacgcatccacttacatgaagtctactttgtcaagttgggcaaaagattcaggtatctctccactcaagccattgtaactcaaatctctacagcaacgaagataaataaataaacttgttttatgtaacgaaagggttaataattttttatattataaaaaatgtattttatcttcaactttaagatgttcataaatataagcatgttctacattttatagctgtctttataatcttccttcagtattattcaaacaaagtgatatggtgttgatgtatagcaaggtctatgatagaagttcataagggacacatgaatcatcagagtaacaaccattcaactttgaaaaattaatctacaccggaaagactatagacatatctgtttcatttttgcttctctcttaatgaagtttagtgctagttagtaattacccatgtttcacggctataaacaaaataataccataactgacctacaaaaccttgtacctggaaaaaaaattatatttcagatctagataaaattatagaacattattatgagcgtagtgtcaatattataatttatatgaaaatatggcttagccaactttgaattgattctatgagatcttctcaagtggaacatgatcctcaaagtaatatatcatgttgtcaaaactgttgtaagttatttgttgaacaacttacaagattttcagtttttccattctcccaatatattctgggatttctcctttaatcatgcattttctcaataccctgcattatgatgtccaaataaaatataggtcatttttataaagacttcaagagaaagaagcatttaagtcattgaacttacagtgtcttcatggatttcaagttatttagtggtgggaaagctgagcttttactagcttttaggtcagttatcctcctaagtatcaaagaataaataaaacaatcacttaacatattcatgttctatgaccaaaacataaataaaataaagaattacaaacatacaaatcacttaatcttgtcaaggcagaaatgctagatggtatgggaccctcaagagagcaaccgtgcatatgcctgtaaccccaaaagaaaaaagttaacatgataaagtagtctatacaacaaatacaacaagaaagaacgaggtaggaaacttacaacttttcaatcaatgtccagttactaatgaaatcaggaatcttcccaaggaaattattgtcacttatcctcctaaaatgtgtttcccaaaggttaatcagtatgcaaggaaatgtcaaaatttaaatgtaacaacaataaaagaacaaaagtgataaacaaagctacagattctttaattttgtagctccttatatgaattgattaagaaacttgcagtgacttgcattaacacctcactacctaatattaaatagaatcaaagtgactcatctttgtgcatctttaactgtcagattgtaaccatgtgctagaatatgtcaaattgataagaacttacaaatcaatcaacttggttaacttggaaagcacgggtggcaatgctcctgtgaatccattggatgacagaatgctaaacaaacatgatttactcatgttaaaacactacagaataatatgtgagggggaaaatagaagcagatattgagattccaaatttccaataagcacacaaagaagatcaaaagaattacagtttttctaaattggtcaacttcccaatctctgttggaatgtggcctgaaaattgatttccttcaatactcctgtaacattcatacaaatatttaatttaaacaaagctgcagaaataaattggaaattatactaaaccaacaatcctggatcacctatgccaagcttcctttaggtaaaagcaaatatatcggcaaaaggtaaaagctacctttagatattccaaatatatctttcacttcttttttttactttctatttttctttaaaaatacattcaatttatcactaagctaagtgacggagtaaacatacaattcatttgaaaataaagaaatgatttcaacatacaagtttctgagggttgtgatattggtgagaactttggggaatggccctgacaatttgtttcccataaaagagctgcacattcaattcacaagaatctttagtgtcactctcaagttgtttactgtatacagaagaaattgaagagacaatgcagagaaaccaaagggtgcaaagcagaaagttcttacagatcaaccaagcgcatggtaccccattgtggaggtatagaaccagtgatgatgttacgactaaggtctctgtttgaaagtgcaagacaaagtaagtggacttcaccattccatagggaacatcatgcagagcaaaaaaaaagtcatggtttcaaaactgagatttgatatcttacaattcttggagatgatgaagcttggaaaactctggtgagagactacctgacagattctgagccttcaagaatctgttcatttagaatatgaaataaaaagcagaaattcagaatttataattatatggtggttaacatgattattccaagatatccaatcaataaacaaatacagtacatgaaatgagaaaagaaacaatctagtgagtcccttgtgtacaaaagttaggaattcctcacaaacagattaaatctaaaaaattaaccaaagtagaatttagaattaattcaaaaatttaattagaatgtattgacagcaggaccgtgtttaggaattttagggcattagtcaaatttttaaagaaacttaatattatataaattatttcttaaaataatttttttagtttttaccaattaaactcatttttatatattatttttatgaatagtaagacatttataagagtattatatattgagatttttttaacttatttttattttaacttttgaaaaccaagttcctactttctatttgattttttcctattactacaaatataagaataaaataaagaagcactgaataatataaacaatttttttataaaaaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaatgttaaaattgttgactttcgtaattattatctaaaaactaattgtgttatctatgaaaaataatactacatatttttggtcattgacatgtatgtgagactagtgattagtaccccttatgtggtaaccatcaacactcaacagttgatctagtgttcagtaaaccctttcccattctttgaacataaattaatcaacatttcctatttaaaaaatcaacaaattactttttactagacacagttcgacagtaacaaaaaaaaaaacaattagtttgaagcaaaaacatgaacgaatagcccaacagatgaaaattaaaaattttaagaaaattttgacgagaaaaaaagataaagacagcacatcctttttaaagtcaaagatttgcaacttgcatcaggtcggttgagttgtcgatccgagacccgtgtccgacatttcaaacttaaatttttgtatgttaatgagttctggtacttaaacataatgaaatcaacattatacatgataagtatataattaatttttgtctctctcaaaaaaaaattgtcagttacttttttatttttttttatttttctggtatacatttattttaaaaatataatccaagaaacattttcctctcttcaccaaaaaaaaaaagaaacattttcctcttctcatttagtgctacgcgttactttgacgagtcacaaccacaaatgtgcatgattaagattcgcgatggtcaactttttgaagaaggcagaatatgcataaatctttggaaatattctaggtaaaaagaaaattagtagaaatacacccattaccattttcttcctttttgcttcaattaaaaaggttcttggaatccagctatgaaaacatgaatttataactgaacaattttttttctcttaaaaaaaaatatgtaactgcacgtgaaggtttgatggtaactttaggtgctgtctgtagtaataaataaaaatagttgaagcaatatggccgtgaagattaattaattaatcaaaacttgaagaaaatcatcttcattttcctaagtgcacatgtgattccatgtgattatcttccataatctgagttctcgaaaacacaaagaataccaaaaacttgattgaaacaaattaaaagagagagaaagagcattacatgcttacaacatggcaagaagaattgtgattgaaggaacaatcacatatcacagaactctcaaagcctttcctagcatcagacacattccaattcccttttccactgcaaggatccaccccaaagtcccagtctttcttcccaatcttgcttcctatttccttcaatgccttcactgcacacaattcaaccaaatcaacttcatcgatcagagaaaaagcaaacaacattcaaatgagtcttacggtaccacagatgcatatgcatagaattattgaattagaagctatgatgaaatgaaacaaccaatccatgattttcttttgctgtccatagatccaaacaaaagaaatgagtgagacaaaaccacttttgactctgcctcaattttgcaactctatgttccgatccaaaacatgggaaagcagaaaggattataaactaatgttatgaagtatgaactgatttgatacaagtataaaaagtgtgtgaacagcaatgagtgaaggaatgagttttaccctcttgagtgttgagcttgggagtggctgcagaagccaagtgtgagaggaaaatcaatgaagtggaaccaaggaggagtaaaaagagcatcttggaataatctaagttggtctccatgaaagtgttttcactctttggttgttcaagcaggaagaaaatgatagggagtgagtcagagactattatatgctatcagatgaggatagacactgggttgcataagtggtgatgttagtagagtctgtactatggtcgggagcatgtgacaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatattgtgcattgcattatttttttttttttttgttgtgaaaatatctgtaaaatgctcagttgcaacttgatggaagacaacttggtaaaggatccagagttaattctgatccttctgatgaggggttaatgcctcttatatcttgattaacaaccttcctaaaacagatctcttaatgtagaagtagttgaatagtcttgaatgaatcaattaaattgtttgtggtttagacttatatagtaataattttctggtgagtttctgctaatagttttaaaatgtaatttaccccccacccaattttattactttaaggatagaccacccaaatcaattttattactagctttaagcacaaaccatcttacccaattttattactttaagcttaaaccaaaagaagttacaaggaagaacggggtttgcaatcctatcgcgtgggaaacgtgcgtttgagacgctaaggaaaaagctcaaagttggatgtgggaaatgtgtatgcaaacattaattatagaattcggattggttgcgttgtggccatatctcgatatcgcttgccttcccagggttaaaaaagaagaaagaaaaactcctaaaatttagattgagaatatttaaaattaaatcaagtctcctgttatagtagtataacttctacttttttacaatttaaacgtaactaaaaatttattgttgtgatttacatttgtgtggataagaattaaaacagggtaaataattcacaaaaattaaaaaaaaaatcataagaatcaaagatactgagaatttataacaattcatatattttgtataaccaattagactcctttggttgtaattttcaaatttgtaataattaagaaatgagcaacatagctcgaaatgatgagactagataacattttgttttcttttttcaattttcacaactccctcgagcgtcgtattgcattgcctccaacatttatcttcaattgaaagaaaagcacggtatttgatctatgtagaattgaccatcagaattcaacattagaataattggatctgttaatttaatttggaagtgttaaacgcactacataggtttgcatctattcatgattcatgtatctttgttatccttattgttgattcttgatttaattgtatatttaatattttaattgaatatatctcaacctagctctagtccaaatttaacatattttaattttgtaaagaaaaaaaacttactaaaaattttagaagaaccaaattcgaatatttttttaattttatgagaaaaaaaatcatatttagcctaaatttaaaaattgattttagtttctacaaaatttaacgtctaattttggtcttcataaaattcaaaagcttaattttaggtcctcataaaaattaaaaagttgattttaatgctcataaaaatgtaaaatattatatttttatttttaatatagtatattaagtaatattaaaaaaaataacaacttttatattcataactcaataattattcttttttatcctaaaagaagagttacggtgacagcggcactagaagcaattttgacccaaaactagctcttgagccaacaaattaataacaacttttttctacacaaatctttcgttaatctatataattgtattatatctttataactaacattcataaattattattttattcctataactattttcacaaatcatccattaatttttattatctttctttttattttaaaaaacatagaaaaatagttaaatatgaagtatccattttcttctaatagttaataatgttaatattacttccttcatttctaattataagatacttttcagaaatttatttgtctttttttataaaactattttctaatttttagattcattaattttttttacatatccttaattattctctcttaaaatattaatgaaaataattaaataattagagataagaaaattataattttataatgatactgtaatgaattatcagatttaatgtaattaattaaattaatcattttcttaaaaatataaattaattaaaatgattttataactaagaattgaaaaagtaatatattacattaataaatcaagctgacctcgtccatcttgtcccatctattattgggttttaatcgaggggtttaaacttacataaataaccttaacaaagttttaagatacgtagaatcaaaaatatatctgtcgcaacccatccatggtcattcctaacaaagttatgaatattatgttgtttttttcttaatataatatattatattaaaataaaaatataatattttatgaggactaaatatcaaacttataaataaaaatataatattttatgaggacaaaaacccaaacttataaattttatagtaattaaaatcaaatttaattttttaagagacaaaaaaaattctcttgtcatatgtgataatcatgtaccgaagtgaataacacatgatagatgtgtcattcaaaatgttccctaagcatatttttaatgaaaaaattttaagtgagttttttaaattattttttgtgatttttattataatgtcatgttatggtaagaaattcatacacaaatttatttcaatggtaagaaactctagaaaatttcaaaaattcacatttttatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggttgtcaacaccgcgcgaggactctctctatcagcaacattcttctccacatcttggaaactctttagactttaatattaatattggcttgttaattttaaagttaaatatatgtattttttgataaaattaattttaaatattaatttgtttcaaaagtaaaacaacgtactcttttaactagcaactaatttttcaacatatatatatatatatatatatatatatatctttttgtattttttttctgaacttgagattgacgaaatcacaatcatggacttgtccaaacatatagctacaaaaatattcagaatccgcactgtttcttttccaatgtcctacttgtgattcttgataaagtaataatgacttgcatataactctcaacagctaccagaaggataatgattcggagttcggaccaagggaagaagaaagtaacatttttgtgtcgtcttgcattggaaatttggaattaaggaggaaagggagatagcgtgtggggacacaaaagaaagaggcagaaaataaatagaatagaacgcgttttaatttaaggaataaaatacaaaagaaagaggctactgaatgtttaatgctcatgatcaatgaagtctcacgtacgtaccctgtgagtgaaaagaatatcaattctaactcgaccattccaaattataattttgagaagaattgaatatgaatcactttataaaaatgatctataagtttgaaccaaaactatttttataaagtaattcagtttagttctttaaaaaaacttaatgatatatgtatgaggaaaagaaaaaactaaactaaacaccgaaccaagttaaaagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttaattagatattttcaacactttcttttttcttttttatataaataataaatactaactttgtgagtttcagaatcataccccctttcagatagaagcatgagagtatagagacctgtttgaaattatcaaatatgattgatacttggaagtcgacttcaaccatgtgattagtttaatcatctcctacagagattcatccctcaatgttctatgtaaccttttttacggtatggtgtattaatgacttaataaattagatttcaaaagtggaacgtagaatgaacatctcacgatgcatcaggacattttctgcacaacaattaagttgtatatgaaatcaaaattaacccatcatctgctcattacattacaaatatatatacggcatgacatggctcatgcagaacaatgcccatttcttctccatctatatgcacggggtataggtatacgtatacatatatgtgctacaaatcaatattgctcagtcatactcaaactttaggaactataatttgtagaaatccatccctgaaaatggggaaagaaacaacaaattatcagcttcaaatgtttataggtacagcacatatctttgaacttgtgcaaaaccacacacatcacatactagtccctgaaattattcaagtcactttcgaccccatgcatgcatatttttaaaataaaataacatgaagtcacatacaaattcagtaaaccaaaacaaaaaaagtacacttattttaagctatatggggaaaccttttcagttttcagcagagcagaatagaggagaaaggtaggggaaagagttccccttgagtagatgtgataaattatatagcttttacattgagttgaaaaatttatgaatcatcatggcagtattctagcttccaaacaaagcattaggattggcatagtattctagcttccaaacaaagcattaggattggcatagattcagtttttttttttttgtgtgtgtatttaaaataacataatgatctaagtaccaaagcagtataaaagtgatggccatcattacagtagctagttgcagcagtagtgaatcagctattttagcctaacagaacattaaatatccaataaatttctcagtgaactcaattgaacttcaaggttacaatttgactcaccattttgtgttagtaaaagagatcactattcactagcctggtactgttggctagcagtgtgatagcttgcagccaaaatcttcctaatgtatgttaggtacctaggtattttattactacttccagtttgaattttgttagtaataatcatttgaaagtcctgtgactgagccagaaaccaaagttactaaaaaattaaataatgcaatagaccaaattagatgaggttatatatatatatatatatatatatatatatatatatagtttgagaatggagttaaaatttgaggctataatcaagagacacgtgcataatactaagatataacttacaaaaattcagctgatattctgtccttgttcacaccagtaggaagtggccagaccaccccatatgatccatatagtatttccctccgatgatatgaagaaaaggaagcatttggacaacctgcaactgtccaagagctagtagagcgtctacctttaacacacaacctgtcacagttcacacattggctcttttatcacaaagaaaggaggtcctatactacgaaagatctatgaccacgaatgtccaacattaaaatttccatttagcgtttcacttccagaatttatgctttatattacaatgcagaaataatgtataaagtttgtattaatagacaagaccctcccccggtacacaaatgaaagaaaaactcaacacaataatggcatagacaaaagtagagtatccaacaatattttgttttgccttatcttttccttcaccactcccttttctattgattagggagaactaaatgcttaataccacaaattgcagagtattacaattaatatgagggtgtatattagagattcttcttactttagttcatcaacctccactcttatgtcactgatactgacacctggaacttccactgtgataacatatttgccttctgattctgcaacatccatccttggagaccactcaattcctgcaaaaaacaaaggtcacaaaaattatagagtacatagtctatgcactggtttgtgattggttttttcatgttcgttcaatcacaaatcatcttgtgtgaaaatttgtgattcgttaacttttacaatattaccttaaaaatcaaattaataatgatttcttatatgttgacaatataaaaaaaattacactaacaatgcatataaattaaactcaaaataatatacttcgatctgtttcttatagctattcaactattattacttcaaatgtctttccgagttcaaagttctaaccaccaatttcagaagagcacgttttcttttcagaatgtaactgatctcctctaatctgtctggttggcctagcaaatgtaggaggatcaagtgtactaaaatcacagccctgctcctgagccattggttggaccactgaatttgtgaaaactgattctgcccttgcaggtctagcaaaacatggtgctcttgcattagaaagacaatcagatgcagtagcaccatgatttgttttaggagcaataaaggaagttgagccaccctgaaagtgtatttgtattaaataagccagtgagaaatgaatcacttacccaaaaaaagtacatcgaacattgttaagtatttcaataataagaacacttaagtacctcttcaattgaagtctgcctcataaaataaccaagagaagcagaagcttggcgtgcaaaatacaccttattatcacatctccggagtacagagttcagactgccactgcagttctgatggcggtaggaaaattgatgaacaaaatgaattacaaacaaatattcaagaaaaaaaaggatagtacgtacagattaatttattagacattgtaaaacaaaagctataaaatcaaattagtggtctactaaaacatataataaaggtgtagcatatggaaattctgaattacggaaacacttttaaatatcaaaaagggacaaagatgaaggaaacacttaagtttaaaaactttgaagttgcttgtagcctacaaaaatgcattgatttgataagagtgttcaagttattattgcctaagccaatcataaaagaaaaggccaacttaaacaattaaatttccaatgctgaacatcaagatcaataaacactttagcataataaatagtgacatcaacagtacaagctaatgcgtctcataatttaacgcaaatatgcaatatcaactgggttaaactatatatagaaaatcagacactgaataggtgatatttcacaatttattcaaagctagctgtatgagatgaaagaacatattttctcgtattcaaaaccaatgagcagtctagctactttcatcctttagccaataaaaaatgaagtgctagtccactttatacaatactcaaattatatgcagtttgattgtcctatgatgacaataaatgaagattcctattagatggttttttctgttcacatgaaaaggagaacaagggccagttagcaaaagatgagaaacataagttcaatttccccacttagctatatctaactcccaaataattcccatgtgtcgagaaaaacataactgaattcaaatgaattcctttattttccatcattatctagtgaaccatgaacacataagtaaaagaacataatatgttaccataggcagaacgttggtagttgaaatatcatcattgggtgcaaagtgagcagcaatcatgtgaattctgcgcttcactgactcactctccatttctaccaataaaaatgcttcacaaaaatttgagctaaaaagataatgcaggatggcaccagcatcagagtatcaagaatataagcagagggagtcactactgaatggaagatatttttaagaaaataacattagtggggcccattaaatctaaatatcttagggaactgaagataatgtccgtcagatgccaccatagcacctggacccaaaatatcagtttgagactactgtagtctgtagtacttcttttttagaattttaggtacccttgattggaattatcttattattatcattataatttaatatttatttttaaaaccttacaaaaatttataattacccataaaaattaaaataatataatataaaatgaaaaaaaaaatgtaatagaaaatgatttttttattgcgtgtcaatttaatactaagtacgttataaatttaaatatcagtttattagttagagaaattatttttatcatttatatagtgtgtgtttaatttctttttgttttcattaaaaaattatgcaccttaaatataattacatagtttactatgaaaattttaaaataaataacaataaataaaattagtaggtttttttttactttaaaacaaaaatacaagcatactctttcttaattaatatcatgttttattctccataattattattttcctttattttattaaaaaccaatgaaaatatctcccacctggttgtctcattcgtgcagaaacaatttgtactatatatatggaaaattttacaaacaagataacccctctgtgcctgtccctggctacaggtttgaattctgaacagtttttctctgaatttttttttggtgaaagttgttctctgaatgaatggccaaagtatagagtaactaagacaagaaataaagcagagtacaaagacatcgaagctgtgcaattctatatacctatatgcattaaacagaatatcacagaatacactgctgacatagagtaagtgcttatttgattgtcactacaaatctatctcacacgttacatgagttttaatataaaatctgtaactaaagataatcagtttaatggctaagcacgactttcaagatagttatagtaaaaatcaataaactcatcctaatgatttgtcataaaataacagtataaaagtactttaatttagatatacttgtttaacaattcaaaatcaattctatcaaaaattctaaaacaaccaaacactagctagtagtagtaaataataataataataataataataataataataatagaatagaaagaaattcataaccatattttcatttccaaagatcaaagcctttatgttctagaggggtaaatactggaacgtggcttgttttatggtataaatatctgtgcttccaaattcaaataatcaaatttaaccactcgagacaaaactgtagaagcctaacatttgttgtgagcattaagaaggaagcaactgagaccattaagtcaaaatgcagaatagaagcaaactacttaaacagacactaaaaaatggaaacgatgattgcagctttgtgatcaatacaaattattaaaacctgcgatgtgatgcttgtgacaaattgtttttgaactgtaatattttaacctttagctagtgtcaagtgaaacagtttaacttaccaataaacgaaaagtgtgacactgatattgcagctttatcaaattagttaataaaaacttccacgcggatttagatttgagttgtgattctttagaaaagttttctagttttctaaggccacctatgtgaaagttttcttttcttgataatatttgttaatagatgctgcaagatttgcataatccccaatgtgtgtactctgaatcactcttactccaatgcccctgctcctgctcaacaaaaagaaagaaaagcaaatgaatcaatattcttagctagcttgattctttgaggaagctccccgtggctactcatgctgattatcttcacagccaacataaggtgattcatggtgtacggtggtgatctatttttaatgttcctttgcgtaggaaattcatcatgtgactaatagcagaactttggctgctgcattgttcatgccaatttgtgtgcactaaaatatggatgtcataatatctgactcaatatatggtttgtgccaatttggtgtttcattgcaataggactttgggagcatttacacttggattgaatgataattatggaacgcaatgtcatcatctctaacgcactagatatgggtggtttctatatgctgtgggatgcaggggttctggtgtggaataattttttatcaattgaagtaattttgtcccaaaacttaaacactccttgtgcttggatattgttctgtctgttattaataaaaatgtagccttttcaaacaagggagcagagagttcaatcgcatttcaattaaacattatatggcaagcagagattaacttttgacacctgcaacttgtgtttattaaaaatgatttatgataaaataaaatggcgtcatttcatacaagtagttgactccacccaggctcccagttaaaataaaaacttgattgttgttgactaagcattcaaagaaacagaaaacaaagggcaagaataagaattcaactttactcgccacaaaactacaaaataaaactgtagtctaattgcacctgcaacatgatatttcagccttctcagccaccatcttttattgcacgtttggggcctaattatagtcaaaaatataaatttccaagaattgtatccaatataagataatgatatgatttgtgctacaaagatgacacgctagagaaagaaacataagaacgaatactacaattcatgtaataaaacagaaccattgagtcattaattccatcaaactcactagggtactttacaaatgtcctcatattccacagctttaagtactctgccatcataggctcctttctcaatctgcaccttagcacaaaaattatctgtatccacccccaacagcttagcaattgatcctcgatatgcaccattgactatttttacacgccccccaacttgtggaatcacagtttcaagctcagcctgatcaactctgagaacatgcttgctttcaagcatttctatttccccaacatacttgtcaattaccttccggacaacgcccttttgcttgtagtaccccttttctgccaagactttgctcataatcttgacaacaattccctcatgcaaccaataatccttccgattaatttcttcctttttcttctcttcttccctcatcatttcatccaaagcagattttccacctccactttctttcctcttcaaattgtttctgggattcctttcattatatttctcttcatcaccctcatcaaacaccacccttgacgcctcatgtttttccttgaccacaggtttagctgatgatgacccaagagaaaatcctatcttgattccatcttccatattcagttccctcagaggctcaacctgtgaaggctgatcagcctcagaattagttggctgcatcatctgctcagccttttcaatctgtctcctgatctccttctcttgcttttcttcatctaccatatctgccttgattctcttattcttcatcctctccttgaaaagggtttctgaatctctatctatatatgtaatgaaccatcccttgggtgtttcctcaaccttacatttgccagttcgacccaagtacttaacaaactcagtaagcgtagcccactgagtggagttcatatgaacgtggtgtctatcatttatgtattcgttataaactacagtggctgccacacggctgaatcggtgactgcgcttcatgtgctccagaaaggtggtctcaaactcttcggaatagccctcaactatccggtgtgggttttgtccaaaaatctgcatttgacgctggtgcccttcactcatgcaatggcatttaaacccattctcatctcggcactgcttctgacacatctggcaataccaccgaagcttctgcaatccttttgctttgattcggttggcaattgctttaggtgtgagaaactcattttttcccatcacgaatctggatgtcacatttcagatcaaacaaaactttatcagtaatcctacacactgtttccttacagctgaaattacgttataaagcaaaaaagaacacaacaaaaacagcattagaacaaaagctaaaattcttaaagcattagaaaacaagaagcagagtactttggagcaagcatccaagttaaataactaatgaataaagttttgattagtatacaataaacaacttcactttttcgctcacacgttaattgaaatccttcaaggtcgaagttcatcatcaattggcaaagattcccagaggaacccaatgattaaaacaactttattttgattctcaacacgatgcaacaataaatcaatggtttttcaagcattctctgttccaacatctttggctcggtatcctattctagtttgcttacatctcaatttcttgaaacacacttctatccttctcggtctttcaatcaaagcattaccaacgaagaatatcaatcatccaatcaatatacaaacaacgaggagagagatagatagatagatagatagatagatagatagatagagagagagagagagagagagagagagagagagagagagagagagagaacgaacctgaaattggcggcaactattccggtggtggcgttcgcggtggttcacggtggtagcggcaactacaattgtaggaaccctagatttgaagacggagagaaactaagaaagcgattgggatcggaaagggttttgtttttccgttcacgccgtgcttaattataaactagcttggtggaacgccatttataaaaaaataaaaatatattttaatcactcttgttgtaaaaaaagttgtattgattaattaactaaatagcattttaagtaatattgataacttaaaacaagtaatatttattgacttgaaaattataataaataatatgatatggcaatctgtaattggttggcaacacaagcaaaattttaattatattataagtgtattttaattaattaattttttagaggatttaagtaattaattttaatatagtattgattgatatagacgttagtcaatcaaataaaatcctatgactttaaaaatactaatcagacaaataaaccgttttcgattatatggcgatttataatttattgacaacataataaattttacatttttattggctccaattaaatatgcatacataaaattgtcataaaatatatataaatctatcacttaaaaaaatagtaatgttaggctcataatttaatttatttgcaatttaagtcttgcttttaatcctcatagttttggttaaaaatttcttaacccaggaattgccacgaatactgcaaatttagggggtatattttctgtgtggatatctagttagaattcaattatcttagggtttgtttgatttggaaaaaaaatgtggtattggatgggataattttttatgatttattactcgatacaaactacttaaaagatcaaaatatctattttttattctattttttctatcttctagatatattagaatgtcaacatcaccgatttttaataatccaccgagttcctggttaatcttcctattacatttgcgtctccacaatatatatagttatatacaaactaagaaaaacaaagcgcaaataactgcagaaaataaaaaataaaatgatccagaaacattagcaaagtcataattatgtaatattaacccaaatgatataggggggtcttgtcctacactcaaatcagaacgctgtctatgcaatccggcatttttcacctgaaaatctacacagccgacttatatgtctaatgctcaggttttagtagaataactccctccaatacataaagttgttcttctaacattacacattctcatcaagacatcagaaaaacaatccctaagaagagagtgattcaagacaatcagttcctaagtacaagctggatattgaattgcgtgcaagaagctcggagtccatatcttcagattaacagtaagaaacctgccacaataatttgaagttctctattactataagcaagcagaattcagtcagtctcaatcaagagcaaccacgataattttcaaataatcagtgaatgtgctaaaagaatgcagtccaacaatgacaaaggtaaaagatttcacaagtgagacagaatacacaggaaatgatggagaaaagccatataaatcccttgttaagaatcttacataattctactatgttaagtttaatatggaatgcaaaaaattgatgtttcgaagctaaataatattagagcagttaaaattcaagtcatagaatgagacaagaatgggacacaaatacagaccacaatgagacaataaccacaaaaaacaataggaaaatatatatttcatagatcaaatagaagaccaaatataatcaccatatattttagacaatagaccactaacatctaaaatgctgggtacagaagcaatgtcctcaaccatgctaaatcattagttaaaataaaatgaatatataaattggacagtaattaagatgtcaacagtaatggatacattgattcagtgaaaagtaatttgaacatgatagaaatggttgtcaaactcacaagtcaagaaaaccagttgagttacattgtttttttaagaagaatttattagacgtgcataaattcactagttcatgagggaatctgacaatccacaagcttgagtcatgtaatttctcgccaaaaggcagtctagtgagtaacattgggtagacatgtataaattcacaagtccaagagcctgaaaatctactgtcctgtgacatctatttttcccaaaacacagtattttgaaacatacagttcacggctcatcaattaccatgatgcaaatcaagcaacactgttgctactgaaactaggatgaacactcttgaaaataggactgatctagggtggagacatggggcatatattcagggcaatggcaaaaaaagtcggaactatgaatgtttattatggtgatgctattaaattatttttggatactatgaatctatgataggctttttttatgaagtaaactcttatcagttcaaatatcaagtcaatggatgttccaagactataaaatagactcttatatatgactataacatgatttttacatagactcttgagtttgacaacattaagaataggcagttctctaaagaacatagttgtcaatcccaaatattggctgagaggcagaccctgaaaatactatagctgaactgcaggatggcttttattctaaccaattagaataaaaagattaaaggataaactttgaggagagttagaatacaagataatacctgttttagagggaatgaaaaacagaacatatgaacagaacaaagcaaggcagcaaaggtcacatttcgctggaaacagtaacaggtttgcattaaatggccgcataattctcagggatgatcataaactatggagagcagaggctgcagatgttggggatggccaactgtcacaactggacagaaaatgctgagaaatactggatatgttcccagaaaaggatgggtgtttggcagcgccaaggccgccatggcggaatggcatggtggttcttttttttttttttgccaaccaccatagacaacaatgtgaagggaagcccactatggcagcaccatagggtgcaatggcatgtttatgtagcagaaatttggatttcagccatccacaattgataacactgactgcagagctattcaatttttgtaaaatgctccagccacaacactttgcaagcacgggatagcaacactatttggcactattgacaactatgctaaagcatgctcctttacaaaggtaaagggaacagaaagaattacacatttgccttaccaccatttggatcagttagcatttaatttccttggttagagtttgaaaatagcttatactagtttgcagggaagttatctttccttgatgatttaccaacaggaataacaataaaacaccaagaaagccagcttggcacttatctggccacaaataaagatgatggaaaggcaaaagggtgggaacgtatgtgtatacacacacatataatatacatatatatcttctcttaaaacagtatataaaaaggtaaattccaaaattgtttatagcaaacagcatactataattttactctgcaactcaaaagtcacaatcatgtcgaattatcgatagcgatcctaatgagtctagaaacttgactaaaaggtattgatgttaaattttgcttcatgcccaaacataaatttgagttggtattattaatagccacccacccggctccaacacccttacaaataaaaacaaaggagagatttatgataacaaaatcagtttttccttgcaaaatgcatgatctcatcttaatcctaatttaccatttaattttccttctagacatcactatctctcacacaaaaaggaagagtgcaagatacacataaaacatagaatgtgtgtctggatgctcagtggatggtaaacaaattgattccgcctcttgtcaaccatggttttagaaaagatacaaatttggtcattgtaggactataggtgataaaaaataaacttgaaatttaagtcgcaaagtcaaagttaatttgagatgtccatggccacaattggcagcacttgtccacaaattccaacaatatcaaggaatgcgatggcagcagcaatttaaaacattgatgttgaaaaatttaaactaaattttacatcaaactagctattatagtaaaatcaatcaaacataaataacttaaaaatcaattttacaaacgcacactcaaacactcacacacatacactcactgactcactcaattctgcaaacacacactcaaacacataaacagaggattgagcaaaacaataaatacaaacctaccaatcatctctcccattactgttgctgttgatttggagggtttggcggagggggcatgccagggcgaggaggaccaaacaccggaacaccgctgccaggtggcggtggcatgccagggcgaggtggtggtggagccggcattccggggcgagggggagccggaggtcctctcaccatctgtccaggagggggaggccccatgggtctctgtccatactgcggtggaacttggaactgtggcggagggccaccaggtctctgcggtgcaaattgcccaggcggcatcggcggtggcggacccctcgccatgggaggaggagcgaattgccccggcatctgccccggaggcctcatcacaggcggtccaccgccgggatacgacaccggaggtgcgttgagctgcggcgggcgcgagatctgcggctgcatcatgccaggggcggggccgccgacaccgcggacagggccggcaaggcctggctgagcctggacgacgggagcgggtgggatacctcttccggcggcgcggccaataccagggccggcgagagcggcggcgccgactgccttggagcgggactcctccggcggaggagggccctcgacggtcatggagatgacctcctcgccgcggaggaggacgaggccgagcgtacggcggtcctcgcggtcgccgccttcggctggcttcttgcccttgggcggaggaagcttgcggaactcctcgcaatcgccgaggacgaggttcatgtggcggtcgaaggccatgaattttcctacgagctggcgaccgtcctgaatggtgacacgcatacggtagttgatgtactgaagcatcttggaactcttcgacatcgacattttgtaaaaatggaaattctcttctgccgcagcttcttcagtgagagtgttttagggtttaagaaaaattgggaccttagaggagggaaaatattgttcactccatacactcgtttcgattaacccaaccaactctcttttatatagtgcaagatccaattaagtcgggccaaggcccagagtccaaaagtgattttttttttttttttttatatatataaaacaaaggagtcttttcatttacactagcataaaaattatgattagataagaaagatattaattagaggataattgtgattaaataaagaaaattatttttttacttgtttatatttcttttgttgataaattatattttaacacaaattgaataccagtgtagggagttttcctttatagattaaatttgaatgaagataaatagagtatgcatggtctttttatattttatttttctcatccatttgtgattattttatatttttttcttttttaggaagttattcattataattgtttttcagaaccctttcaaatataactttttatgtgcatgtttaggtctccggtaggagattccaaacctaggtttgtaaatataattcctctaatactattggactcaacttacgtttgaggggcttccaccagtttcccaaacatgctttttatcttcattatttatgaatgtgctattagttggagagcaatgctttaacttattcttgttttgtctaccaaaaaagtgaagtatatatgtcattaacaacaggagttgaagaagatacgttaatcactggaatttgattttcgatttggacattattgaatcataattaaaaatattattttatcctaatatggtctaagctgggaggaggagagttagatgagtattaaataagaagtctcgaatacctgtttgtcacacaaaaaatgtatgaaattataagatcttattcatgatttgggtttgaatatgtaaatacatattttttattgagatattcaaagtgcattgactttagctaaaaaatcaacctatgatgctgagtgaatttcgtgagtgtatgtaatttgttttccataaagaaataggcacaacagtcaatccaattgatatgttgactaagactttgtttactaatcaaaagttcaagcatgtcttggatttggtaaatgatcgtataattcaagacccttcagggttagttgagaggatagtatttttggttagtgacgatttgatgtgtttgtatataacataagactatttatatgttatttgtgcaaaattatatagttttatattttgtctccctttgagtgtaggttacgttgatcgaaccaacataaaatcctcatctctctctctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcttattatatttcatcctatttttgctcatttttgttaaaataacgatgcatagatattttatgttatttgataagagagaaaaaataggagaattaattttagatataatgataatatgaaatatgatatatacaaagaaagacttcattattattttcgtctctcaacttggggattaaaatattttagtcttctaaatttctttttaatctttcaattttgaaaactgccatttttaatccttttcatgattatgataattttaaaatgcaaactttggtagcttaaaattaaaaatcaaattatggaacctaaaaatcatcacaaattatcgatctattattctcaccctggcaagagactaaaacgaaatttaaattaaaaaaataaaaccctaaattagggagttaaaactgtaattatgcgtaaaataaataaaggaaaataagaagcatcaaactatataattaatgaacatatctgcatattactttttctaagaaagtcgacatatcacatatttcaattaagaagtaaatatttttaaatatgctgtaagtattgaatttactctttcaccattttgatggggagcagcaaaacctgtatctgcgattctccctctaccacttcaccaagcccactgtttttatcatctaatttcaggttttattggattaaattttttaaatattattttagtataaaaaataataagaaatgatgacggttggataaaaaaataaaattaatataattttttaatagttatattgattttagttttatattctcttatattagcatcttcttattttcacttttgaatttaaaagtagatttaaaattatactttgatttttttatttttgtagaaatattaaaattattttatgataaatttaatgatatatttaaatgggataaataataaaaatatactataagagagtagtgagggtgaaaattgataagagaattattaagttacgtggatgatgaaattaaagacataattacaaaaatattaagttaaacaagtgatgaatatagtatggtaatttaattagaaaacaaaggaaaaaatgcaagacataagaatataattgacattttttttattccaaaataataagagagacatatgatacatacatcttgaaaaatattaaacagaaaaaaaaatatatgtgatgagaaaaaagaaaatatgttaatcaatacaaaaagaaagaaaaaaatctaacaaaattttaaaaatttagatgaaattatttgataaataatttatattaaaaagtatgatgaaattcaccaaatcttaaaaaataatctattaaaattttgatagtattatatactaaaaattataataatatttgttaaaattttaaaaaataatctatcaaaattttatgaattttttaataattttttatataaattataaaaaattataattaaataacaccattttttttaaatcttaactatcttaattgaatactaaaaagtttatttatagtatttaaaaatatttaaaaaacctgattcaatatatcccttcgtctcagcatctctcaaaacagattcctagtcatcgatccttaaaaagtttaccatatcttttctatttttatgcttgatcttttctaaattaaggtaacaacctagtaagtttatcggattctgccgcagtaaattcgatttgcgctaaactaagcatctgaggatctcagaggggcatcacattcacattgagccaaatcatcacagcgacattctcaaatcacataaaaaaaatagtgctcagtccgtgagagttcgtatcacggctctgacactgacacattcgcacgggatccctactttcttctctcgtttttttattctcccatcaattatttagcaacccattaaggttctcgtcagaaagtttacatttttattgttagtttttaaatatatttttcatcgtttcatcagtgtgatcacacaccatgatttgcaccgtgaaacaacccgccatatccatcagaggttctgatcttttcctgcgtaaaaagtgttcagcttcaaccccagttcagtcatgttcccttgtttcaccttcttcaagggaaaaaaactctctgagatcattggtgtcagtgcaaaagccactgcacctttctcgtgttggttttggagatttcgttgggtctctggtgaggcgtgagcgtgctgatttcgtgacatgtgaggcttatgaggctgatagatcagaggttggaggggctggcgctccatcagaggctgctaagaaggtgaagattgggatatactttgcaacatggtgggcactgaatgtggtgttcaacatttataacaagaaggtgctgaatgcattcccatacccttggcttacctcaactctctcccttgcatgtggctctctcataatgttgttctgttgggccaccaagatagttgagcctcctaagactgatcttcagttctggaagaatttgttccctgtaagtgactcacttttgtttgtttcctcaggataaatttgatgggagaaaatgaaagcatgcttttttgtttgttcatttgttataatttacgtgtacttgttctggggaaaacatttttttttaagaattattttgtcccatgttttgatatatgtgtgtgtgtgtgtggtttgacttcagggaagcttgacgatttcatgaaaaagagaaagagaaaatttaattcatttaaactatgttgatgaatgggaggaggtttacaagagagatttttttttttaatgatggaaatttaagttttggaaaggttttagaaaattgtttgtgactgtgattttggccgcaatgtcaaggcttttgtggcctttgtggctgcaattcgccgcaatatcaaagatcctgatgaaacctagaccgcgtctgtgaccgcaatttaattaagaacttgaatcgttttggcttttccccctatttatttatttgtttattaacatcttgatatggattgggaccttagtgtttgctgttttcccccgcaggttgctgttttacatacaataggacatgtagcggcaactgttagcatgtcaaaagttgccgtatcattcacccatattattaagagtgctgagcctgctttcagtgtaatggtttccagactacttggcgaggaattcccagcgccagtctacctgtctttgattccaatcatcggtggatgtgctcttgcagctgtgactgagctcaatttcaatatgattggtaaagaagttgcttttctatcaaaaaaatgatctgttatctaattttgttctattttgtatattgttgttgagcatagtataaaagttggatatgagaagataatctgacttgaactaaaaaatttgacccgagagaagaaaatttgatggcaagttattgattaaggcaatgtcataatccctttccccttcctccacaagcaaagtgattattactggaattctatttatatatttatttaattattatgtgttcatgcttgtgttgagccaccaacggaatggatgatttactattatataagattcttgggtgtttatgccattagcagaggttatgatggaatgtacataacttttcatcttttctgcataggagtccttcacaccctcctgattttgatttcattactgttttattatatttttcaggttttatgggggctatgatatcgaatttggcatttgtactccgtaatatctattcgaaaaagggcatgaagggaaaggatattagtggaatgaattactatggttgtttatctatgttgtcccttgtaattctcacaccatttgcgattgctgtggagggaccacagatgtgggcagctggatggcaaacagcactctctcaaattggaccccaaataatatggtaattacaaaatgtctactctatctgatgttatcaatgctatgtttctgtaaaggtgatatcttgaaattatcataaattcataatatttttttcctacaattattatagacatcttgtgtccttttcagaaattcaaatttattggatgttgggcaaattattagttacatttgtttttgtaatgtgtacactatctcagagcaggagaaggtaaggtggaggtggttggattgtttatggagttgctatgtagttattagaaattagagcaaatctttttcgtataactagtcatagacgatcaacattaaaagctgcttaaaagtagcatgactaaaaagtcgcatgatttttgttttaaatcttaattgttcttggttatttttagaaatgcaaacatttcattataaaaatttgattttaaattttcagttcaaattgtttatttaattgtaaatctcacgtgattttttcctttttaatcaaagatcaagtgagattggaaattaaatatgcaattaacagttaatgtcaatctaacagttgtaatccaatgttttcatttctcacaaaaattaagagttctcaccttcacatacacatatgctgctgaccgtgaagctggtgtgaaacctgatttatgtgtttggattttcaaacaggaaattgacctgagttcttttgtttttgattttgagttatctaatattcttgtcctttcacttgtggttctgaaaatcttctgcattgttttgtcttatgattaaacatatggctgctacttgtgcacaacaggtgggtggcagctcagagcatattttatcatctgtacaatcaagtgtcatacatgtctctggatgagatctctcccttgacatttagcattggaaacaccatgaaacgtatatctgttatagtttcttcaatcattatcttccacacgccagttcagcctattaatgctctaggagctgctattgccatcttcggaaccttcttgtattcacaggtattatctagatgagaattttctatagtgatattttattgttaattattgcgccccttggccatatcatgcactaaatgaaccatatacatgctcatactcttacttcttattggttggagccttggaggatccttttcaaaggttgtattaggttggttttggaggctagcttcaggggtgacatagattgtgttgttagacattgggtgattaggtggaggaacctacactgtcaaatactagtgtgcaaactgtcttgggattatacttcaaaagatatttggtggaacaatttgattttgtaagtacacaagaaggaaaaatttgagatttatagtcataggttagaattgagtgatggagctattctaaattaggtgatctgatttttatttagtagcttcactttgaattgccacctatgacctaaactactattggtttgaatccaccatactgtttattccttttctaaatctattttattacgaattagcatatcaaagcttcaaaagttgactgcaccaatccatttgttcacatgttaagtgtccttttacatatagtttgttgtggagggccttgaaatatcaagaaaaagattggtggtaagaaagtaagaaacagagtactgactatgtggattgcttataatgtggttttcttttgaaaacaacaattttagttgcaggtatatatacacaatctctcattctacttattttttgcaggcaaatcagtagggttgaggagttcagaattatccccgaacttctttacatgtggtcatacaaggtcaccgataaggaagttagttttggaatgtggtagctggattatggtaaagactggatgatccggctgtctgcctaattgtacataataattaataatgatgacaccgctgtggaacattattattagagattattagttttttgcccccctctatttctgaattatcattaagcttgaggaataaacgtctgtatttgtttggtctgaggataatttctcaagacatggcatattataataaggttttcttaataataatcaaagtacggtgatcttgtttataatggtcgttatgattcccattaatgcttgctaacactagtgaagatgctggctggagttttaatttatatttttgggtcattcttgctttaaattagcctttgattagcagatggaggcccagttaactgcccctatcgtgtccgtgattatacttctattctattttttttttttaccgacaaatgttattcgttagtttttgttagtgagcgaattcgaatttataacatcttttttccttttttctttaatcatcaaattaaccttataattcttaaaactgccctacttaattcatgcacgtgtcatttgttagagagatctctctaggccatctaataataattggatttcggtcaattttttgagaattaacgaagaaacataatctaatgtatttataatatttttaatggcttgaagattgttcacctcacctcacaccatcagacaatttatgagaatcattactttggggtgggtgattcttgtatgtagctttggtttttgctgtgtctcaatttatgagaatataaagttgtatcacgagcttatgaaattttgagtgagaaatatgccactgacaaatagattagtaatatgagactaagctccaatatgggtcgtgatcagaatttggggatggtagattttgtatacgtactactagaaggtgaagtaatgggaagagcatatatactaacagaaacacttttagtctagttcacaatagaagtgaagtatatcatttttttgtgttgatacgaagtatctatttcatcttcaagtgactatcttgttttaatttttagatgtttagttttatagaaaaaagttatttgaaaaataaacctcattattttatctcatttaaaaaatgaacttcatttcctaaacgaccttttatgcttactgatgaaatacttcaattttaggagatcttgtttcaaatgataatactttctctattttgaaagtcatatgattcatatcgcaataatataaggttgttaaaaataaaatctaaattaattaaagaatattttagaaagaataccattaaatatagtgaaattaattaagattaatttgtttatattttggatcaccacacttaagtttagatttacttatcgttgaatctagatagtagcataaaagtttgagcgtccatgtctatatggtcactacaactaacaagttccatttgaaagaatcactcttatgtatgctgtgaacctgataaatgtaaacccaaaaatgagatggcatgaggtggaaggaagagacagaaataaagaaaaaagagagagataaagtgctagatgtgatgaaaaatagagataaaactaaaatgaaaaagagatgtatgaaaaagaaagtgtgtaaattgaatattttcctatatgctatttctaggcatgggtgtttcattttgtcaaatcacttgtatttactacatgtttgataggaaaatacataagatacactcatttaagccttgagtctttgaagctatatatattcatgtagttttattgagactaaagtgtttaattctcgtgcactcaaacaagtttctttgggttggatggaagtgagactcagtgctattaaggctttgctttccaattgtaacatgctggagagtttgaattttaaaaggtgttggaattcagacaagtttgacctaggtaaagaaaaacacatggatctgacaaagctcgtcctggactaataatgcggctttgattttgattatttcaaagtcaactaatgaaacaaatctcaaaattttcaagtattgcgggtggatgaactttgacctcatagaaattgattcactcgcaatggaagagatagattttgatttctctgtagaatattcatttgaaggatttcgttatcctaactacagtttggtggaagatgtttgtactgctaaagttttgactgtatgtagttttgtgcttcagatataaattcttcatcaccttttctctccctcataataaatttgtcaattgttatcatatattagtactagttttataattatatataagtgtatagttacccttatagtccatgataactttcactcttttgacatgctccacttctgtttggatgaactgaaatatggattaattacaatatcttatctaaattgttttaattaacgtattgtgtgtgatattttaaggtgattcctactggtcccgaacgtatggaacctgacatggatgtacatgtgatcatgaagatggccttgcaacatataataagtttattggaatctcattcttcctcaaaagttgtcctatgttagagcgtctcaccactgaactaggttcaataaatgacctgtttgtgagtatcaactacgtaaattgaatttgtttttcctatatacatatgtgtgtgttaaattttgaatttgcttttaacacatctatatatgttgtggttattttctattaacaaaaaaggagtctaatttttattagaatgtggattttggtgcatggataacatggtggatggccagttaatggatctaggataggttctgataccatattagaatgtggattttgacttaactcaaccccaaaagctagctcataaggtgaggattgttctccacttatatactctgacttggcactatctctagtcgatgtgggacttgagttatttccaataatttttgctctatattgtagaattatgaaccaccgttttattttaacagcacacaattctggattgaatatttggatgtttgtgaatgattgagttcaagttgagaagtggtggaaattaatggctttagaggaactctaaatgaacacctcttgctcaagtatttgatctttcgtggatttgtcttgaaaaagagtagcatataaacatgttgaaggatgattgcggtaagactgtggagtctgattgccgtcaaatggcagaacttctgttgacatgtccaagggcttcaagaaacttagagatatcaatcttttaatagatagttttgaagaaagtgttgaatcaatatataatgtcttgaaaaagtactctatctttaatattattttatagaaccttcaactttttattcacaaaaaaacaacttaccatgttatatgtttaagttctaaatcctggtctttgttgttatgcatttttagtttgcaaacgttacttattaatacaagacatttgtctatattatataaacgcattttatttagatttcacagatttcattagatgcatatatatatgttatttgttatttaaaaaattcactttacaataatagcttttaattgtgtttcagcttaagattttccattcttttaaggctaaaatttagtatttatgtgcattctaatatcaatatcaagcgtggatattgacagatacaatctaaaagctatgcagatttatgttatgtagtattttatcaaaaggacaaagaatcatgaagacagaatccaagtttgttgcttttatggcaagagaaataataattttatttttttctctttttattgagatagtgtaatctaaaacaaaattgatatactaacttggtagaatttgaaaagtgtttttaacttggggtaagtcagggagcaagtggtacttctcatctatggcttactttttttaaatttaaattatagtaaaaactttataattagtatgctactaattataatatatatatcaagtcttagacatttttaggattaattttatttttgatacattagatatatcatgatttagtgattttggactctgaaggcacagttgcgtgaattgaatcttttaaatgtcacaattaattatgcatttttagtattttttttcatacttttttaaatatttaataaatttttcttatgtgacactaaataagaacatgttgatgaagtgacatttaacatgttatttaaaaaacaaattgacatgtcttaattatatttctagtattttatgtatcataattataagtgattaaaagtgtaattatgtcatatcagtcatatagaagttattgatttaatttacattccaaaatatttcttaagattttaatttgtgttaagtttcaaaattctaaattaaaatgatatatatgttaaattatttttcaaatgatattaaattcttaaatttaatttaaataaattatttttaccatataaaaatagtattattaaaaaataatatagaagtttttaaatattttatcttttataactaatccagattttttaattaatattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaacacaaatgaagaaaacaatcccattaaaattttatgcattttcaccaaaggttggtttcattctaaatccaacagtaatatattatagtaattaattaatatatatatttatgttttcctaaaaaaaattctaataacggccggcaacgtatacatggaatttacagaaaagaaaaaaaaaatacaaaaatccatatagaagtatgcaacattgttttctcactgaagcaacgtctgttgcatatataaggtagcactcatggccatttcacacacacatttcaatcccattggaatatttgaagaaaaattcagtaccctaatagtcttctccacatctttattatcaatcaccatatcatatagctagaaccatggcaatgagcatctattcgttgccaatggaattgcttataactatcgtttcacttcttcccttcaaggaagctgtgagaacttctatcctctcgaagaaatggttggagttgaacgtttgcaagttcacaaaaaacatagagtttgatgaactcttttttgttaaacctgatcaacctaatgaaacaagagaaatccaaagaaggacatttcttgacttcattaatttgtggattgaaaatcacaaaggaactttggtggagaagttctcttttaggttatcaaatcctagaaatggtggtgagatcattgatcaatgcgctgcttttgccacagagcgtggggtgaaggagttggaacttgactttgctgatccgaactggaatgaaaattattatggtaattatgacgaggcgcagtttcaattgccagcacgagtttaccagcttggtagccttgagtctttgaagctatattcttgtagttttgttgagactgaagtgcttaactttcatgcactcaaagaagtttctttgggttggatggaagtgagactcagtgctatcaaagctttgctttccaattgtaacatgctggtgagtttgagttttaaaagttgttggaactcagacaagtttgacctaggcgacgaaaaacataagggtcttagaaagcttgtcctggacaagtgccgctttgaatttgatgttttcaaagtgaacgcaccagatctaaaaaatttccagtactgtgggttaatgaactttttcatcacggaaattcattcgccctcaatggaagaggcaaatattgatttctctcaagaatatggcttcgaaggatttggtcatcctctttataatctggtggaaaatctatctattgttagagttttgactgtatgcagttttgttcttcaggtatacattcttcatcaccttttctctcttgaaattaatttcttaattgtacgttatcatatattattatatattctacttttataattataactttcagagttccactcttttgatcaatttgttccatttctttttcactgaattgaaatatctaattacaaaatgatttgttgatggtttcaattaacgttttttgtgtgtgatgcgataagattattcctaccggacccgaactgctaggttttcaaagtgacatgcttgtgcaacatttgatcttgaagacggctttggacaagaacgagtttttgggaatcacattcttcctcaacagttgcccgatgttagagtgtctcacgattgatctatgttccgaaaaagatttgtttgtgagtatcaatcacatacattgaatttgtttatcctttatatatattaggtttttgaatttgctttgcctatatgtgtggttttttcatttgaaaaaaagaaagctgctaattttttgttacatataatgtacttaggattatgaaacaccgtttctgtttaaccgcacgcgattctggagggacaacgtgggagtttatgcaagcttgagttcaagtctggaagtggtggagattaatgggttcagtggaactgagaatgaactttttgtgctcatgtatttcatcggtaatggagatatgttgaaaagggttagtataaacatgttgaaagatgattctggtaggaccatggaacctcaattccgtaaagatgcagaatttttgttgacagttccaagggcttcaagaaacttagagatatcaatctgttaataaattagtaataatattttaatttgagagtattgtgaatgtgtgactgggtgctacattaaatgttagcgtataaactctacaacaaagtcgatatgatgttataacatctctatgctaagagtttatttcactgatttcatcaagctgtgtattcatttttagatttcgtaagtttaattacatgagggtattgaatttggtggttacttaaaaatatgcaatttacatcagctttctatgacatagtacttgttttcttttcttaggaattgtgtattgggttcctattgaacacgggaggaaggctaactaaatgttcctttaattaatatatattactttgcgcatttctttctctttttaaagatgaaaataaatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacaataaaaacattcaacataattgcatcactataaatcacattcaaaaatattacatcacttcaaaatcaagacaaatataaacaacacgttacacattcatctagattttactctttattcagttattctcactcgtaatactataatttcttagaaatattgaacaattataaaagaaaatgtgttagagagtaacattaaatgaataaaaaaatacatcataaaaaagttatatggaaatagaatttctcctttatcagggcatgtaaattaggtatctaggtggtgaatggtgataggtcccagccaatatatatgaaaaagttgacttgttttccttctttctcattctattttttattctcctttgtcctgctatatacatacgaatcagtgtgtaaagaacaatttagaagtcaattatgggttctccaactctcaaatttcgttccactgtccatggtaagttaaagagcttggccatgataaacttgaaaattttgttgacatttatgttgtgggttgcacttgaaaagaaaagggttgccttcatcacccttgcatatctccttgcctgtatttatgtgacgacgtaccaagttaaaatttgaaaaaccaaggaatgtgataaaaagttgtagtattagctttatttaaagtgaaagtagtgaactgtgaacacatcaatgatccgactttaatcaacatgtaagccccaaagttaatgttaaacgcggaaacatggaactttcataaatgacacatgctgaggttccaaataagactcctatttattactagaagaattattctttgttcccgagtcaataggtgaaaatgaccaaggcaagtaaagcagcccccatccatatatgtactatgattaatagaaattaagctaccaaaacctaatttgcagcagtaattattattatttcattcatttacctgtgttacaattgtccattgcacatctgggggaagtctaacaaaatcgtcaaacttggttcctattagaattggaattgcagtctgcaaattgaacaaattaaatgtcatcagaaatttcataaaaaatacgtcaaaatcttcaaaatttggatattatcagcctaaaacagaatatttagttatattaacaagccattttgatatattgaacaaatagtataccccggcaagtcaataatcagggttcatttctctgtccagtcttaatgaaaaaaattaatgtcactttcctgtggatactcaatccatttgcactgctacttcaaaatttctctcgtgttttacaaaaagagtttccatgccaaaagcctttggaaactacactttaacttaaacagtggcagacactttctgaaataaaatcaattcatgtaatagtactatatataagccctgcaaaattattttttacggtacctgattccactgtcttgcttcattataccatctaacaacactgcacgaacataacaaagtacaaaaaacgcaaatcatcattatttctaccattacgtttctaagaagtaagaaccctccaccgaactcatgacacagataatagtatctcttagcctacctatttagtgtacaacgactggtgagatcgaacataatcaaaatcgcaaccgcatctttacaagccatgggaatttgatccaaggaccttttatctcctacacacgtcacataatataaagtcaccgtcaataagtcaattaactcaaaccaacaaacccagaacactaaaaagaatgaaaactaaaaagcaaatgtaaaaactaaaaagtacacacagacaaaacagagaaaaataaagggaaagaaaggtaaagtttaagcaaagaacctgcaacatcccatattctaaacgaaatacgagctccttgaacagacaaagttttgtccattagattcaatccttccatctgtaagcttctcttttcttgctcattccccacatacttgatctgagaataggaattcacataaccacaagctagttaattagacccgttaaaataaaagactactacacttgaccaatttcaaaagaaatacataatatatgtagcgagaatctaatcacaaactttctcatatatagtaaatttgttaattctcatgataaacaagctaaagaattttataaaagtaattttttaatattacataaaaaaattgagtgctgagagtattctggttgagaattagatactaatctttggagacaaaaacagtctcttatatgcatagacctgaaattgaagcctgaatacaagcttaagattcctgtttatttgttaattatgtcataccatgttgataatgatgtaaaagtttttaaatttctagtacacacttgttaaattcttccaaaaacaaaaacaaaaaagaaatggtaaagttagaaacatgctgaccacaaaagtagtttttccaatatggcaatcacccaacaagctgatcttgaggttcaccaaatcggaatcggagtcatagccgccagtagtggttgcaacggaggagaagacgtcgtcaacggtggccaacggcgaagaagaggtgtcccggaggggtagtttctggtagtgagatggccttccggcgacagagcaaactagaagtctgttccaaatgaaacggaaaaagtggccaacgaaagatacccttttgaggacaccccaccggacttcgacatgaacgattttccggcacagctgagacatcttcctagtggtgtcgtgaatgatcttcttcgccatcgagcatggtttcttctcggtgaatattcacataacagatagatagttagtacctaatcttcttctttgtagttcttcttgttgcggtgcgtttggtatattagtctggtttctcggtcccactgtttaatataggggacagttgaccggtatttttcatttcggtttcctaaactctccgtattgccgccttcttggtttctgcgtagagatgggtaatatggtaaatgaacctgtagtagggggtgtgcaaaaacctattccttacaaaaaaaaaaaaaaaaatcgaaccaaatttattctaaactgttttaaccgattcaaaaatccaaatagtcaaattattataaataattggttcgaaaattaaattaattttaaaaattaattgtaaattgaattgattttgaatcagttttaaatcaattttaagaattgaactaattttgaacgatttttaggactgttttatttttatataaaaaaaattgatttaaatgaaaattggtttattaacaattaggttaaccgaacctctttagtacaataatatagttcttttttttaaaaaaataatttaggtgaaaattggtacgattacaactcgatcgatagtctgagtgttttcttgcacacccttaacctgtagttgtagtattatttatacaaatatatttctataaaagtaaaaaaagatatatttcattagcactcatttttttttatcacatcatatttttattatatcctttttttttctgttttctttcttccactcttagatgtcaaaaagtttcatggatgttcaagaatatttgtgttattttatctcaaacttatcccttctcttatcattttatttattgtacaagaaatcgaacaagagtgttatggagtgtggtatgagagaagtatatgtatctttctcaattgtcatgatgcattcggcatcttatggggtgtgtggtgttaagaatatataggataggaattgaaaaaccgagtgtgatgactgatgaggagttatctgctgtggagagggcgcatgatgtgaccacgtagtctaatttcttgtttaattcccgtgctttaaataataacatccatgactgaaagggtcggaaataattttattttgatatttcttgctgattattattagcattctagtattagtttgaaattgaattgaagacatgatgagaaattgagaatgattacatgtattaaaggattgaacgttagtgaatggtgacgttcttctcaaaataaaaaataataaaaatacgactgcactgtttaagagtttctaaatcagaggttcatacttaatattctaatcatatttgtcctttttgaaagaaaaaaaatataaaacataattatatctttaatttgaattaaatattttataagctaaatatatttgttgaatataaagaatattccaccccattagtacaatgtattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttgttatttagcatgttaataacacacaaatttttatttagcatgttagacacgtctaatgtatttgaagttaaacgcgcttttgaattagttttgctaaagtcaattacaaatgataatagtaaaattaattaaaaagagagaaaataaaatgtttacatttgatttagttgatttcaaactaatttaaaaagtgaagaatagaccatgattagattctactagatttatagtatttaactaattttcacattaggaattgcagggagccacagaaccgctaattatattagggttactgttattattagtggaagtgggtacagtataccatcaatttgttggtatgattagacaaattacagattgctgctctgattggtggatctgaatctactgatcacactgagagcataaaagtgaaaactacatttgataaagaaaaaggctgctgcaaccctgcaatcttcctatcctttccctgacaccaaaatgtatgattcaaatttaaaatatacattataaaattaaaattaaataaccaactacacatcagatgtggacatactatatgtatatgggtctcccaattgccatgcattgattctcctttaaaatattattacttgcaggtcatatttagtcaaaattatactatagatttgtagataacattacttacaccagcgagaaaagaaataaagtaaataaaaaataggatagtaaaaaaatggaaataagagtaataaataagaaattagataaaattttagattcttaattaggtccaagataagtaaaagaaaaagaaaaagaaaatattatgaaactgtttgatttggataggagaagaaaagaggaattagattagatataaaaattctattccatcgttgtatataaactttaaactctcatatgaatattagatagttataggatccaatttgcaggacataatagattatctacgcataatacattattgggggcatacataacaaattttagtgtgcatataatccactatagtagcacaaataatagattatcagagcaatggggcatgcataacaaattatcggggttattgtaaataaagtagagaagttccgttggcttagggtgccttttagatccacgtacaagaagattttcacgttaatataaacactaaaatgacgcagaagctacttgtaacagctttggataaacatggatccagtatatattaacgctaatccaaatatgcggttagattttttgttatttcatcgctagttcacatgaaatctttctacggtgaaacctacttaatttttatttcttttttcattatttcatcttaaccaaaaatagactcaccaaaaaaaaaatcttaaccaaacaatctaatttttaactttcactttatttctacactttcttctcaatttcttattcgttttattcttaacataataatggtgtcatcataatttttttaaaaggaacaatatatcgttttacatttattttgatttcaaaattaactttggctcactttactgccacccccaaacattagtacagcaatcgtggtttttgccttcagatatttctgtcttttggttacactaaggggaaaatatgaataaaaaaataaaatgatatgtcaaaaagaaaagcattaaaatgccactctagttacgaggcgaaaattaaaactgccactttagtttttttgtactttatttatttaaattacaaatatttatttttcagtatttgaatgcgtctatggtctcggttctaggaagtttacattgctttgacttcaacatctagatagcaaaccttggtacgagatagacgacacctccaccaatatgtcacactttttaaaaaaaaatagcctaaataacataggcacaggaaattttatcagattatcatatggtctattttactattcagtccaccgaaatatgtgagctgacgtgacacaattctgatggttatgtatttcgctgcagggaccagcgaaacatgtggtgtgatcaaaacaggcaggacatgtgacagacagaaggtatttcattgaagagcccagtgttacgtgacaatgaaaaaaaaatcttaaaacttcaaacggtcataacttttgatagaattgtccgattaagatatacgatatgtcaaaacactcgaaatttagagaagaagccctgggctaagtcccaaaggggatttactccactattttttctttcaaaaaacgcctctaagtgcctcaaaattaagatttaggattcaatcattcaaaaaatttattatttttctatctttttaattatttaattagttaatttaatgctatttttatttttttaattacttatcttaatttcaagcgttttgacatatcatacgcctcaatccaacatttctatcaaaagttaaaccatttgaaagacatatcgtacgcctaaatcctaattttgagacacttagaggcatttattggaaaaatagtggagcaaatccccttgggactttgcccaagacttcctctatgaattttgagtattttgacatatcgtacacctccaactgacaattctatcaaaagttatgaccatttgaagttttgagatttttttttcattgtcatgtaattcgctgggctccccagcgaaatacctcctgtttgccacgtgtcctacctattttgaccacgtatttcgctggcccctgtaacgaaatacgtgatcaccagaattacgccacgtcagctcacgtatttcactggactgcgtagcgaaataggcaacgtgacagtctagtaaaatttactgtacgcatgtcatttaggcaaaaaattttaaaaattttgcacgcttggtcgatgaccccagatagagaacaccccttcagatctaaaacctatttgctattaatttattgtggaatatttgtaattccaaatgttgccctaaatgaacctagctatatccatgactgaccttatactttacttagggatgctacccttttttgaagttggtccatgtataaaagtttagactatagagcaaggtatctagctaaagttttattgattaattatataaacccaccaacctatctatctttaatatattttatatgttttaatatgaatttattttgttagttacatagatcatggagttaggataatgtaatgaaatgaacgaaaaggttctcaccaaactgacattagtatatatatgtaaccactgctaattactaagtataattaatttcgctaacttacacgtaactacgaacactgtcgttgataattaggtttactaaattgaactcaggatcaactaactagaattaggtttactatagtttgcgttggatgttgatgcctagaatacgaacatacgtgttgacaaacagaaattaagaaagtgaaatgcacacgacttggaattatgcttaattgcaaaacctgtaatcggtgtaattgagtgatggggtcctttgtaaattgatttttgtgttatttgatcgtggaagtttggtaaagtttcaaagtgtgttttgtaaaagttgggatttttgtcttcctaaaattcaaaaatgcgtgtattgtacgtgaaatactttcggtgggttggcatatcatctttatacaatttggaaatcttgcacacttcatttgttgagaagaacctcaaaagacacacttaatagaatgattttttttttttaaaaatataagcactcaaataatcaactatagaaccataaaaatttaacttatttaattttctaactattgtttttcttttcaaattaagttttttttaaatattatatatactcgtggacataataaaagaaatagtaatattggttgtttctacatttattattttaaactatttgaataaaatacagtgacctaaaaactagcatgtgcatgtcaatactttatttcttatatacaatgacaatcttctgtatacaatcctgcaaggatctcctctacttattcaatagtttattatatcttgtaatacgtatgtttcacaattatcgtagaagaagaaaaaaacctcaactttttttatggcaaataaactcgactgagtatcaatatctgaaaaactatcgtccccaaagggatttttgagcttaaaagagactttttcttccattagttttagtccacaatatgctttgagaaaaaaatcttaacaagtagggtttttatctaatttgataattagttatgtttaacaaaaatacttgataaatcaattggaagttataaaaagttttaaatatatatgtttttaggttgaatttgaactcttattattttttatttacagatcaaatattttattaaaaaaattgaattaatagtataagtttttcgaataaatagtacaaaaattaaaataagtaatatagtaacaaaggaggctatatatgagaaattttattaaaatattaatgataaaaatgacaacattatgttaaattatacgctacaaattacgttattttaagtagaaaataaataaataaacgttaaaagttaatgagataaatttattgatcaaacacgtatactttagtcaaataaattcataaagtaattaaataagttattagataactataatagtttaccaaactcactgaaagtgacatttggttgttaattaaataagattaatgtggaaatggaataatacacttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttagccattaactctcccactatttatttttttggctttggtctcgtcaccaccaataaagaaaacggtttcatgagttgaggttactgcctattatttccttataaacccgaaatgaacaacgcaatcaggaattaattggaaaaaaattcacttctcttaaattagaattcaatcactattcctaatgtcctacaagccgagcgtacatacaagcatgagcaaacacacgacacaaataaacctacgtttttttttaaattaatgttatgaattaagaaaaatcttaaacaaaattgttctcatattttaactagctgagcaaatgctttctgacttcttttctaatttaaataaataaataaatgttaattgttcaacactccttacatacatttactaatgtgtaaaaatattaagattttatttgaataaacatatttatgagagaggaaaataagataaaataaattcaggttctttcaaaagttaaaattaacttttacacttagttgtatagaagtttgttttttcatttaatttctataaaatttatggtgcataagttgattttagattatagagaagttcaattcattttatcttgttattacactctttctaactaaatttttattattagttgaactttatagaaaacaccaaattgctttggtttcactttttatttaaagaaagtttttatttgatcaataaaataattatgagaaaaaagtgtgttagataatatcctgtgctaacactcatctttattattatttggtggtcagaagaaaggtgttaggatcaactgttagttagctttaagccttcaaccgaataatacagttagttagttacagtggttgtacagttagctcatagattgggccttgaatgtccagttcaaacaggcccagtttgattcatgggaccttggacgacgatgtttcaagaggatttttgtcatgaaaccaagcagaatagaaagttcagaatgggcaactgtggacaagtgaaaaggcaaagacatggtagagcttcttctacgagcatcacctcctccacctcacccttcttcttatccgaggtaacaaatccaactaatatgtccccattttcatctttagcaatatttaatgttctatttttgttgctcaacttgtgtttatgcccctttatttgtttttccattctggaacaccccttagatttttcctttagaattttctcctaattccaagtattttaacaatgatttttttcccacgtttgttgcagactcttttttctgtttttttcttacatttaatttttcggttccttttatttttggtggacttcaattttcagtttatgtaatgtagcttttccatattcatatgcacagcattcctgaatgaatttcctttatatactcccagaattttgtcgtgtaataaccaacttttagtgaattagattgcagactcctttttttttctgtggtcctcctctttcattgggattctaagtgcatttttttgtctcttcatttgtagatactgttaaatatcaactctgttgctaaaacatgatactcactcaacctgggatcgtatgattttttatttttatttttgtaatttatctttctgttgttgtgcaaattggatgacattttgtttacagacaatgcaggacagtgtcaggaaggacattggtgaagttctcattggaagtcccaagtaaggttctgacaaggcatgtcttatctgggcttgctgcttccttgatatttatttctccagcaaatcaggtttgtaatgtattccacaatccaagagtgttactacttactattgaaatttcagttaatcatgcaatttcaagatgtgatatgtcccatgcccatcaggaggacctacttaacgttctcacagtattttttttcccaaatacatgatagcaaagttttaattgtggtgacaattgtagtttcatcgtgatccttgatgttgcgggtaattgtagacaaatgcaactgatgtggctgcaattgcgattgcgattcagttgcagtgactctgaaaaccttgatgctgtggccaaaatcgctatcacaagttgtttgttaaaactttgctgatggtagtgtctagagactttagctatagtggttcataatcttttttataactccataattacatggacattacctaaagcaaaagccattgctattaaatattaattattttgcattatttgatgccattactttcttttgtggatctctttactcgcatagatattttgtatcactcttgaatttttcccacatttgagttcttacaaaggctggatattgttgattgataaaaaatctagaaaatagatgtatattcttatgatgaatgagctgatctaatgtgtactcatttacttcattaacagactattgcagcagatctatctcgtgcaccaaataatatatgccaacttgccagtgccagtgagaatgcagttacttcaccatttgacaatgaaaaaggttcaaatctaatgatgatgagaggaatgacagcgaaggactttgaccctgtaagatattcaggaagatggtttgaagttgcttcacttaaacgtggatttgcaggacaaggccaagaagactgtcattgcactcaggtaaatgctaaaataaatatagcagtaaatatacaggacgacatttggtttagaaaaagcccattatatttatgctcttccaacatctttccctaatcaacttcatattattcataataaattgttgaatttggaggcacagacagaatcctaaggttgttcattatttattaggcgtgtgtggataattctgtcattcagtagtataacagttagtacatcttggagataagatttatcatttaccttatttggcttcgacaagcttcttgatgctaatttgggtatactatgacatttcagggtgtatatacgtttgatagggaagcaccatctatccaagttgataccttttgtgttcatggaggccctaatggatttataactggaattaggggaagggttcaatgtctttcagaagaagatttggagaaaactgagacacagctagagaagcaggaaatgataaaagaaaaatgctatctccgctttcctacattgccattcattcccaaggaaccttatgatgtgattgctactgattatgacaatttttctcttgtttccggagctaaggataaaagttttattcaggtatttactgaactaaaaaatatagcttaagtttgtagtcattgagcttcaaaaggctttttctgaatcttcaacgatggcatatatgacatctagtgttaatttattatgttaagataaattaaagaaacaatactgcatcatacagttctttaattaatagttattaattagcatgtaagtgtatgatttgattttgcttgtagtgttaatttccctgtgatctatatcgcagatatactcaaggacacctaaccctggacctgaatttatagagaagtacaagtcttaccttgcaaactatggatatgatccaagcaaaattaaagatacacctcaggattgtgaagtaatgtccaatagtcagttggcagctatgatgtctatgtccggaatgcagcaggcacttacaaaccaatttcctgatctaggactcaacgcccctattgcgcttaatcctttcaccagtgtgcttgacactttgaagaagcttcttgagctttattttaagcagtaactatgttttgttttaatacattttgttttaatacatgtacttttgtaacgaatagctagctattcttgatagtagcctgtgtgtatcatgtaaagtataaactacctgtatctggtgtcctgtgtatattgatatggtgttttatttttccctccatcccaaaaataaatgtttatctaaaattaaatatcgtcctatgttattttatacacataaagaaaagttattaaatagataaaagaatagtaattttataaaattaatcttaagattattattacattaaaaaataaaataacacttgttagggatattagtgaaaaaaataattaatattatattgaaaagttaaatgtaacatttatcttgagataatttttgttttttttcaaataagacacgggacggagggagtaacatttgactatttgactaaggttttaatctgtgttgcggaacaagttaattggagacggttttcactctcttgcagtcttgcttacctgaatttttatgcaacacttagattgtttcactttaaaatttatatgaattcatattgccagttttcgtactaataacacctcttataacttttatgttaagtatcttacaagttgtacccattttggagtgcatatatcaaattcattttatgaacatatatacaatatacagaccaaaataaatcagcatttgtaactagaaatgttgttttccctctcggacttgcttaaaccacataatcggttatttgggaccggagaggagtaacgtaaagcaaacctacataatcattgttaatgtttactaaagcaatttcgagtaccccttggaattggttctttttaagttttaacattccctttttaatgtaatcattgtccccccggaaagcgaatattgacgtgtatgattacaagtgtcaataataaaatcactaagactgtcatatataaagtcgtctataattaagtcctaaaaaaagtcatctaaagttacaataatactatttgatacgaaatcttttattaaaaaaaaatgctataaatgtctcacgatcaattgttttgtcaaccatcggggtagaatacacgtctttaacataaggagttaaagaatgtatacggttgtagggtcatattgataacttgggtgtagatgttccaagccatattctttattgtgatagtcaatgtgcattgaatttggccaagaattttatctatcaatctatcattttaaaaaataatcaaaacatattgatattaggttgaaagtaactcaagatgatattaaagataagttgttctccatggaaagatagccattgctgaaaattaatggatatgttgtcaaggcctttgtctactgagacgttcaagtataatttggacttggttaatgattgcaaatagcttgagaccctttgaagtcaaggtgaagaaatgttgatatgtattttgctaacggggacaattcaatgttgattacattgactagatcatgtaattttttttctacatttttatttgtcctcatcttctgccataatatgtttcaatgttgggttcctctacaatattgtgatcataagaagttttactttggttatatgcattatcattcatcactacgatgatgtaaatgaaggcattatgcttggcctatgacaagatttagaaagaggagaattctgttgcacaacactttgcaaagtcgagaggatttttttcttaaaaaaagttttattgattttattgcttttgatttaagatgtttcaattgagtaaaagaatatgattagaattttttcttaattcttttaacacttaataattattattgtacaattacattagtaattgaatgacttgaaccaaacaaaaataaatttgttcggattacttaaaatttaaaccgaacttgattaatcatcttggctttaactttcatattatccgatttgagaacccaatggcctcacctatttatagttgtttttatctcaacaaaaagataggtataattttgaaggaactaatatattcttaaaatgcacactatatggataaaatagtaaggacctggtccttttcgtgaatgagacactccttagctttggttataacgattttgtttttccaccttatggaatgaaatctatggccaagaagtgaaatgaactacccgtgagtgacaccaaagcaaaggccgtgacgagggtccagtaggattggcggtttgaagagtaaggcacaagttcctcaaacttgctctatctctttttggtagtaaagtagggtggcaataaatttatgcagataagtagaataaagggaagaaatggattccataacgaagataatatttaaatataccaaaggaagattcagctaacacaaatactatagttgcaaatcagcaatttttttagattcggaatttaattcagagtgttttcataatcaaaagtcataagactaatcttttaaaaaagtagagcactatttaaagagtaattcctttactcacgaatacttgttttttctcataataaaaaattaaatgtctatcatatatttaaaagactcaagctaatagtcacttgtctcacaccttgtggatgcaaattaagatacatgaatcctgcatcttggttttcctaatagcatggtttttggcttatttcaaaataacaacttaactcattgatagatatagattcgtaaataatgttacatctttctcacactcctgcagaaccccatatgaaacaaaattacaaaatagatggagccaaccaaaataatccacaattcccttaacctgaaaagcactcaaataaatagttgctttcctgatttagttaacctactattccttgccaactaaaacaccaatttacttaaaaaagccaatggaagagatcgtcctacttttacctttcacatgaatcccatcagatccagagtttcaaataacgacctagctagtagcatgtacttaggaacatgatgaaacttaaaaaggtggcacagtagttaggactagagtgttataactgcaagcacatgaatgcagtgactatgtcatcaaccaatctcccatctatctacatagacctatgccatggatttcagtttcagatatagaacataaggtgaagcattcttgtgaaaccacatctcctgtaacaaaagaaatgcctcaaaatctctgcagtttcccctctagaacaaacccacaaaccacccttaaatcaaaagattttgctttctccccaacaccaaccaacaaaagcatgcataaatccactacccttgactcaaatgacacaaaagataaggatgaatttcccccagtagaaataggaaccagaggcacagttgcatcactcataatgcaagaaattgagtacttcagcagaattggttccaattcacaaaggaacaagtcccatatcacagaggtgagttcatccattagtacaagttctacaaccacaattgtatctacagtagaagaaagtacaaagaaaaagagaggaagtagcaagcttttaccaagtatgtgttctatggtggatgtatcagacagtggtaggccaaatgggacctcagccttcagttacaggaacctgaagtctgacacaaaaaaaattcaggtctagataatgctctcggatagcttcgaaaaaccgagcttcttaagacgacttgccaaaggtgtagcccaagccttttctgcattcccacattttatgtccacaatttcaacaatgttaggtatctttttatcatttttctccctcactggagttctgaccactgaacatttatcagaacctagcatgggtactctctgtgtatttctgccattagtttttgttttctggggcatgccattgccaggtcctctacggtttgtagttttactgcttccactgcttccggcttcaactgatgattttctttgttgtagtcttttttgggttgtactgccacagggaacagaaacaggaagtgtttgagttttacttcttgttgaagatacctgcttctttgatgcagaagagatgtgaaccaattcccttgtcattaaggaactgattgttccagtggtgcctagcttgatggatcctcctccaccttttataccttccagactctgagccatgctcttattagtaacacctccaattctatatccaaatgttccagtctttgagatgaatgctcccagcagaattattcagtgatctgttgcacttacaaattagtgtcaccctgtgattgtaaagtcataaatttcttacaaattatttggtttggtttatctttcatgtattaagactccgtttggataaatttctctacaaatacttatagaaaataaaatatgaaagtaaatgaattgaacttctttcatacaataaaatcattttatacactttaattttcctagaaattagcttctataaaagttaaagtgcaaaaattaattttaatttatgaaagaagttcgatctattttactttcttatttctttttcctataagtacttaaaagataaatttatccgcacaaagtctaactatagaaatagagagatatgcgtcataattttcaagagaaagagggatggggtggagagttactagattcactaacaaaaacatagttccagcatcaaatcaacaacagcagaacaacaattctgaaataattcaaaaacattatagactgtgcatcacgatttcaaaacaaaacaggtattcatacactgcaatgtactctctctttgtatgccatgagacaacaacaaccacacttcataacttcaggatgagaatgccaactcaactataaaaatttatcatggaaacaaggggagagaaaaagaactaacccacatagcaaaaattcactaccaaatcacaatggttgggatgaagcagaatcaaatctaaaacactacccacattaatagaaccagagaaggataaaaggaatacagcttcaccaaaagacaagctaaatcaaacgcaagaatcatcaaatttgacaaactaaaataagcatacatacacaaacagaaaaccaatgatttcgtttgaacaaaaaggcattaacttcaaattcaatcaaattgcctcacttcaaagtgtggaaatctaattctaacaagtaacactgcagaagaaagaagcaacattttagatccacaaagagaggtaagatcaaataaaggaaaaacaaagtttggtatcatacacatagcaagcttatggctccacacgcatgaaaattgcagatttgaaacagacccaacagaggtagggaacttttttgctaactttttgagctaaaattcagtgaaattgaaagttcggaggcaacgagtttgagaaactgcctctgttatagaaaaaatcatcatatcatatctaatccaaccaactttgaggaacaggttctgtgtcttattttgtagcgtgcgcatccaatgctgtgttgatttgactcacaaacataatcgtcgtggaaaagttaactttcccaccaaatattcactactcattatggagaaatcaaatcataatcatcaacatagaatactgggtggaaattccaaatggaatgccactctctagcactatctttcttttattacttgatttaatagacaaactgctaaaataatttgctacaataagttagtaaatgtagatggatgaattaatgatgtcatacttttttttcttaacccttcactttttattgaaaaagggaaaatggactaatataaaaattgtctgtcaaaattgaacttaattctatgattcaattttaatctgaaatttatgttcaatcactcaattactgattacaattgtaataaaattgtatgtttgaaataagagaaagaaaactataaagtaaaataaattaatttttttataagttaaaatcaaatgatgcaatttaatttttatataaaaagaattcatctaaaagttgtgatatatagattgattataatttataactttattaattaaattgttactaaaaaagtaatccaaaacctaactttgagatcccaagagaaaagggcaaaaagtcagaaattggggctgatgagttcacagttgggcagaagaagaatcacgtggtcacaaaccggccaaggcgacaggatccaacttattacttacctgccatcatcctaaagtacacgctccactctattgtagtactacaatgttatcacatgttcataattttagatttaataaaaatttataaatatgaattacgtgatagtaatttttaaattatcagaacattttataaaactattatttattaaaagaatattcaatagggtaacttattattcttctaatggtaacataaaacaaaataaacatttcaacacacttgtgttttttttctctcttcataattgaagaatataataaaagtttatcacaaataataaataaataaataagagaatttaacataccacactatgactctcgagaataattttaattatgataaaaatttatttattttattattattaatgttaattgctagttacatattttcccatattctttttcttaacgcggtctcttttttatattttttctaacacgtttttattattaattaaaattattggaaattataaaattgtttgagtcttaccctttatttaataagttcactcaaaattttgtagttgtcgataaattttggccaataaaaaaaagaatgtgttagaatctagagagtgagttgctcctctttattttaagaaaattgatttctataataatattcattattttaatttactttacaactaaatcactaaaaggattttattactgtaataacaacttaataattacgtttttgttttgtttttcacatatatcctctttacagacaatttgttcaatgtgcaatttcatagtgcacctcttccaacaagaattcaaacattagttcatcatattatgagggattagaagcttatgctaaacccaactttcgtcagtaatcacatttaataatttgcaaaaaatcattggatgtcaataatgaaaaaaatgaagaaagaaaaggaatggaaagaaagtattttgtgtttaatttgtacataattaaggaagaaaaataaggttttggtaaatttgattatttcgaatttagaaagaatgggggtgtgtgtaaatttgagttaaaagaaaaaaaatccttgaattataaaatattgctagttttgttttattttatttaagtgatgatttttttaggttattattattttttaatttatcttgtaccttgactagttttttttttgtattattggaagcatgtttatgttattattttttattacggtttatttccgtttaaaggtatttatattattttataatatatctttgtttcttattttctactcaattaaattagagaaaagaaacttattttcctttcctttcactttatattctaccaaataactaaaagatcatttttttttctttctttccacttacgaaaccaaacatagtatattttctattcaccacaccattctaggtccaaatcctaccacatgccctgtacaacaagcgcatggctccgaagtccgtacgtttggaaattgcggcttggaaacagacccaaaacaatactttgcactgaaattaaccgaaaacgaaacttctatttggatttttggataaaggaaatgtatgcagtgacaaagctttttatataaaaaatatattaactcttatattttatcataaataactaaagcatataaattatgtgacttttttttaaaattatataatttcagtaattatgactttaaaaaacttttcatttatatataattatgcagttcaaatttacttttgaactctccacaaaattcctctcgcaataaatatacttaatacaatgtgtcataaggtcttcaagaacgtcatatccaaccagcattttgacacactcttcgcgtctcattatggagtgcacatccactgctttgatttgattcatatcattgtggtaggtgtgccaaaattagttttccccaccaaaaatattcataattcagtacgaagaaaacaattttaatcatgtacataaaaatagtgggtcgaaactggaatgcctttaactagcattaactttcttaattcaatggtatttattattaaattttttatttaaactcaagaaaaagtgaaagtttgtgaaaaataaaaatgaattatgtttaataatagaacccacttacgatatgtaaaatgtaaatataaaaaaatactggaatgggaagtgaaagtttactctttcacaaaaatagaggacaattacgtagtttgcactacatggattttatatatgatgatcaaatgacaaacttttcatcaaagaataatcaggtaattagctcctgcaaggcatgcataacgtttaaagtaggtccatggtccattcttgtaggccatttttgcgctcgttcataagattcataaattcatttgtacagaatatcataaattcataattctgcttgatattactgaaagttgtcaaccttaattgtcactggctatactgatcatttgtgcatgcaaagtgctatttgagcgtccaattatcattgcatgatgtttctacaaagaagtatatgtttgcaacagatcaacagaaatgcagatagattctttttataataatttatatacaatattgatatagtttgcatcatcagaaaacaacaaaccggtacatgatgcaaggcatgaaaaaccggtatacattcaaaatatagaagcaaaaaaaactgctaactagagaagtaaaacgccgaggccagtggttttggcctttttcttccttcaaagcaaaaacgtgttatgctttggtatattatcaaaacataacactggaaaatgtcctaggatgtcaaaaacctctatagaaatcaacctcagataatgatatttaaggcataccaattctgccttgaaaatagaggcaccagagtagcagtatcttttgattgcaattaccaaaggaaccatgcagccaaagatatctgaatgagaaaaaatctccaaacagttgtcatggcttttcatgctgtataaaggactaccactatttcccagagtaccagttttgagcacacttggcatcaacagagaggtcaactttaagaatgttcttgccgttgaagggtttggacatgcactcaacaactatggacttcgcaacctcagctgattctgttggtccttccaatatgacttcatcatgaacctgctttgacatatccaagaatcttagtgaaaaagtagcaagattggaatagatatctgaacacattcagatttgaaataacctcaatatcagaacatactgattaaaaataatggttgatagaaattgtaactttatggttactaatatcgtttaattgcttttagattaaggaaattgcctcaaagttggcaaaacgaactacttgttgtggtggaatagttcaccaatggaacaagttgtaatgtaactgcaattacattggttgataacaagaactacaaccaagataatgtcattaataatcaacaggaaaagaagaaaaaaagtacggactacataggtatcacttaatttctccaatgatccatagaaaatgttttgagaagacagatgcataaattattgattacatagtaagcttatagaatatgagtcaaccaagctcttgtttgcgtattacttaatgcttattcctccaatccccctcccaactcagggaggaagaatggatagaattgcttgttgattcaagactctagaataatggcaagtgagataaggtgtaatttgcagacacactacaataaaagcaaggaagaatttttttttttttttttttacaaaaaaaggaaatttagggggcactaaattacctgtagaagtaacttccacccaagctccttcaaccgtttattcttggaaatttgcaacatagcacacatggcaacatcagctgcactaccctgttgaattctacaaatcagaaacccaaaaagaaaggtatgcatgtgggaatgggtcacatggtaatagcatctccacagaaagcattgggctattatgagtcagactgaatcttcaacatttcagacagcacgatagggatttaaatgacaaagtaatgtatttatttcaagaaatcacgtaacctcaagccattatccaatgattaagattagctcataccattaccactccacaagggcctatttacaaattcacaatctccccattcgcaagtaacatgatgcatgaacagcaatgaatagtttctactaaatgtaatttttgtcaatctaacaattgaatcataattagttataaataacgatggtgtaaaagctaattttagataaattagacattatcagtatatttaatcaaatagtaaataatttcttaaatttttagtaataatatatttatatttatctttacatttacaaactaatggaatatatttacaaattctatgggcattgtaataaaccaacaatcccaaaagctataagttgttaggtaaagacatatgttttggactatataaatgtactcatttttacttactatcaatgaatgaaatctgaattttatgattcttctttatagcttttatttgtaggtttaatggtgttttcttaggagtagtggtagagtagaattagcactctatccaatggtgctttcatcagcttactcccctcccaaatccaccacaaccaccatggaagacaaccttcaaggtattttccgaaattagatgccttccagaaccaactcaaccactatgaagaaaataaaaaatctcaccacactacccttctaaggtccatggattcctttcatgacactttcacctccaccgtgcatagcatgatgaagcaactctgctctcaatcttcaacatcagacaccacaaccactgccgcaatcgccgccactgtcgcaaccaccgccgcaacagtcgccaccatttccaccacaacaaagtttctcctctccgtacccttgctttaacaatatttcccatacaaccgttccactcatgaacattttccccaaccccaacccgtctctgtatcaccttacccacttcctggtgttgcaacaaaatctattttccctacatcaaccttttcaatttttgcaaccccaacccaccacccacaatccccttacttcaccgttcactccaaatccacaatcacaatacagcaccaaaaagcaaccaatgttttgcgcttgggaaatttcccagccgcactgatatcacccgtccaatctcactgcaattgaacctaacctccttccccaatcacacccgtccatcatattagaaaataagacatctagatcaccatgtgtcctttcacccatgtacactcccacatcacagctggctcccactctctcaattgcatcaccagcccttagatctccaacgatccaattaccacacatctaagccattaaaatcccaccccaaccatgccacatacatcctctctaaaccatctccacttaccaaattttttcaaaatcctaacaaccatcaacaccatccatgtgtctcccttatcccacatagtgcactttctcataaagttatatttcccttccaaccactggatcaaaacaagtctcataagccttttcttttttcacgtactgccaccaatttccaaaacccatccacaattattttcttgcccccaaaagcaacatactcatcatttgcaacaagctgttgctctcaattccaattgttttcaaaccttgaggacaaggttgaatgtgaaccggtgggtaatgataggattggctctaggcccaaaattaaatggtccaaggattatatagggtggacttaaatatgtattttataattatagtttttttttttaatttgtgttagaataatatgatgttgacacttggataattattatccttgattgacatttttaggactacataaatgtactcagctttacttattatcatcaatgaatgaaatctgaattttatgtttatcttctttatagcttttatttgtagctttaatggtgttttcttaggagtagtggtagagtagaattagcactctatcaaatatatgtaaaggaaaaataatttcacccaataatggatttcaaaaaaggagattcctgatagggaacagtactaactagactaatacaagatgacactattgtaatgttaatacaatcaaaatctattcttattcacagctctatctggactatcatttcaatataaactatggaatatgatattttacaagtgggctctcaaaatgtgatctcatcattcattgttcttaaaagggaaaagttccaaactagacaagaatcacaagataaataattcagtacattttttatttactagagagtgtaaagacagttagatagatgagtgagggagacacagtattgatttgtttattagaaagagctaaggacctgcactggagtattaatagcagctcgctcaatgtgacctttctgataggtgttagcttgggccatcaaagggaaccgtcgagctctccctagcaatgtgtaaacacaatgtaacacgcgagcttcctttttacgctcctcttgccattgcaaaacctcttttctatcattgtaccaaaggtcaactgttttcttagcttctttcacagaaacctgagagtgaacaatcaaataataaatcaagggcaattttcacctttctaaatccctcataataagtaaaagttctgggtaccttccaatccttggaaagccccacaggagtcttcccatatgcaattgagaagttaagcattttagcttttcttctttcagaagcaaaggcatcctgacatggaaggaaaacaaaaatcaaaacatgatcaatcatgaattggatggttataagttataacagtaaaatgctaaaacagctttcttatatcttgagggaagggcatcaaataacgttaaactgctaaaaaagcttattaatgcctggtgtattctgatttacttctgttaatatacataaacattattaaacacattatatatcaaaaaactcggtgaattcttctactaccactgcaactatgttttccccctaaacagtgttctaatgagcagtagctgtcctttatttctattggaaagttcacaagttatttgtatttgttctgaattttaataaagtatatttattctatttgccgttgatggatctgggtccaatcagaataaggattagtcctccctcatgcatctgccagcactctggtggtcactatatttgacgtcatcagctacaagaaataccaaactaaagactaagccactacttccacatctcaatgcaatggtacttctatcagcggacagttaccttcaaaagaggtactgggggtttatcttcaccaggctgaggatgccactcaagaagcacttcctttttctcaactgctttacgaatatgtgggtacatattcattgcagtccttgaatggaaatctccaccagcttcaaaagcttccaacatgctcttacagtctgcaaggtgtgccagaatcctaagttccagctgtaacaataaacaaggcagttaacagaatgaaatttcttgaaaatagttcaattagatagacaatatagactgttaacctgtccataatcagcaactataagagaattcctgggtgcagcaatgaatgcttgacggattttgtatcggtccttttccagagcaggttgattctaattcatgaagtgtatgtgttaggttctatattgttttgaaagtctgattaatctagtagatgtaatatccacatgtcaatgtcaaaatacaaattgaaaatgaatgagatgcattgtgcagtccaaatttaggatccaaatcattgtaataaagtaacagaaaaggcatcaagaccaagtagacataaaatgattacataaatgtgtattgcaattagcaaggctgtgattagtccaaaaacactaattttaataagatatttttaactgaaggaataaatgaatacaaaagaatgtacatttgagcagagatgtcaagaactgactcttgaccttgagatatttgatagatgacggcctaaaaagggttttatatttttaacatgctacctcacacaagaataattcaggtttgaaacacaaataatccacagacctatttcaccttctgctgaattttatttttttgttcaaccttactgccaaaatttagttaagaaaaacagcagcaaaaagatagagtggaggtccaaaatggacttatatgtctaataggaagaaaccctactaaaaggagaaactacattttaggttaaaagacaaaatgataaagccatctactaagagtttagcatcaaggaaactgtatgacaccaattagtgaacatacaagcacacagatgaaggttaatggtcagatctcaaatgtatagcacttaaaaaaatttgaagttcacaacaactactattaaaatgaaaattcctaatcaaaaccattagagaattctgattaatctaattagaataacctgcagatttggccttcttgctgacaagcgtcctgtctctgtgttgatatttaaggaacaatgaacacgaagatcgtttcctgatatattatgtccctgacaaagagaaactgcagctattatagagcacatataaagagctatctccaatgagtattttaaaagctcaaggtactgtggtacttgtgagtttggtgcacaggtgagttgtcaagcatctcattgactgatgtttatataataattataattgtctaaaaatatcctttctagggaaaaaatagaaaaatatcatcaatttattacggacaatatgaacagtatggaagtttgtatactagtttcaaaataaaagaaattccaagcaagctcaagaaagttcatattgcaaaccaaacaatcaaaaaatacctgcaggggaaggatgaagttggagatcaaagagttgattgaacagacttgacataaagcagcaattgcatggcaagcttctctcccttctttctctgttggaaaagctgcataggctgtcccatatgcagatttatcaatttttacaggtgcaacttgactttgagaaggattttcatcttcatcatcaagatccaagttacaatcctcatcaaaaaagtcataatcagcggaaatacttccagccagggcctttaaagcatcaccactaactgacggccaaccagttgctgtgtacatctcagtctccaggttataacctaggcttgtcaactttatatcacgaaatttttttggagccttcttgccttcttcaatcacattatcaacattgggaattttgaatattcgttcagttggaagcgtctgattggagtcctttctgtaatgaagcatgtgacaagtgaaaatgaaaattttacttccatctatatccttcagctacttcgttgtaaacagaaaagttcataaatatcaaggtaggtaccagtagtagtaccatcattcatgaatagtgaatacattaatcttaagaatatcataaatatttcagcctttgactagcaaatcattaatttaagattgaaataaatgctacacgtaagatttaaaaaatgtgcacctgttcacaatgccaccaaaaagaagctggcgcaactgcgaatcacttcccacattcatatactgggcatcaggacaatacctagtggcccacttgcggaatctattaacagcaacctcttgctctgctttggccaccttttctatgcattcaagataagcccggtcaactagcattccctcagattccatcatgactagaagctcaccaaatggacgccaatattcattgtagaaatcatacatggttttcccataaacttgcaaaccatcaaatttccagggcatgtctgaaagatggctctttaggctttcatacagcttcaaagtgctgctagcatctaaggcagaataacatatccaaggtatgcgctcatctctctgtagctcttcaacaggagcaatgatacttgttttaccctcagatccatcctttttcaattttttcttactaaatatagttttcattgacaccttaccaatcaagtccttttcatggttcagctgagccctagacatgacccttctgtcacctgtaagtccttcaagagaataacccccatccaaatgtcttgaagaatcccataatcgtgccatgtgcattgtatcagcatgaaatcccgaaactttgaatccataattctctataacatgacagtcaaagctataattatgccagacctacagaatgcaccagtgactcggttatttcaaatatggtttgtaatctctggtcacgagcatagacaaacccaggaatttaatgccaatatgattttataaaagatagatttaattttctattactacaagataagaatatctaacaactatacaaataaaataaaatagaataacaaatcatgctagttcacttctatcataagatgaaaacttctctgttctatacaataaaaccatgcaccaactatcctaaatcaggtacacattaacttaacattaggaatgcaagttgcaacctattcttagcatattattgaaaaattgaatataccactgaacacacagtaaaaatcgatatggctctctgtataatatgacactaaacttttagattacctgaggttaatttcagaacagattgtagctgattgtcatatatcttaactaggaaggcatatttcatacagtagcaagcatagaactaatatttgagaagtgttgcatgttgaggagagtaataggattaagaacatagaagggatagaagaagaaaagttcaccttcttgatggaagaatcgctaaaaaattcagcaaatttttctaaaatctctttgcctccaccatcaagaacatctacccagatacaggactttccacctccaaaatcagcttctggaccacaataaatgctgaagcatgttatctccccatgatctacaggagtttcttgtttgacatctatcttggccacctttgaagacaataaaatcagcagataatgtgttacacaaataaaaattagttgaattcatgtccaaagtacacaaacagacacacgtgcacagaagcaacaaaggatataatctagctatatagactcttgtgatatggagtaaccataatacaagtaaatacagtaaaaagaattatacctcggtatcacatgcataaataagatgccggaactttgttgtaagcatcttagcaacttcctctgcaagaggaatattatcaacaaccagaatatcatcatatatactacaaagcctatcccggagctttgattggtcagtaccacatgcctgtttagtaagtgttacattagctgaatcctttgcagttccatccaaaccatgatcaccattgactacagggactttttctttaccaatccccaatgaagatccattatactggcgaatcaccctttcagaatccattaacacctttgaattgtttaatacagaatagttaacagaagatgggacatgtgcaccagaatcctgcagtacaatattgctatccccgttcttaggaacagcctggttctgatcaatggaagcaactccattagatgcactaaaactgccattttcactctcaaatttatttgagccattcatttcctttttattttcagttaacttatcttttgctatagtccagcctctataatcaccaccagacaaattttttcctgaagtggtttcggaaaattcattgttgcaagaagccatgcccatcgtcctaacttgggcttcacatgaatgcaaagagttcagctcttcctcctcagtcatttcctccaacgtgctagttgatgtatttgaagttttcatagatgaaatgcaaactggactcttgcacagaaaattatgcttacacctcacgccattgtatttatttaaccccgcagatatcccctttagacagcatgagaaatctgctctagatagtacataatttctaagcacagtgctatttcggagggaaatttggaatgacttcatttttcttctgcaattcacatcatgcaacaaaaataaaggttccaatcaatgaaatgtagccatctacaagctaagaaaaagcttcatctgtaggcatgtgtggtacaaagagaaaatatatctcttcatcactctattcccacatttactaacaaaagttaatccccgggtagcatccttaatattaacctatttcaggttttatcatcaacaaattgtcacagaagttacaatacaagtaaaatttgaaaagtcacacttgacttaatgttaataccagtctcaacctttcaaaccagtgaagaacaacaaggcacactgacccatagaagtaaagacaaaaaaacaacaatcagcatattttactgtgtaacataaaaacattaatttcttaagctaaaagcagaatacccagttggaaaagatgcaaaatttaaggacattaaagagatgggcgaggtcagaagcaacaaaagacatgaaatttgaagtgaaataaagataaaggaaaaagggtaaaccgttgcagaggctgagaaggtaaaagggaaggaagagagaagggacttgagaagcagccgcggcataaagggcagtgtggccttaaagcagagacctccattgaggcagaaatcacctccgactgctcctgctccctccactgttaaacagattaggagccagctacttaaatatataatatataaaaatatacatacatacatatatatatatttatatatatatatatatatatatacacacacatatatatatatatataaaaggagacaaaatatttgaaaaaccttggccattaatataaaatacgtataaaataaaaccccaaataaaaataatgtgttataatatttaattgccacgtaatcttatgattggaaggctaggatgccctctcggtcggcggaggcataaataggagtcttaggtgcggtttgacgtgcttttaacttaaaattatgaataaacactcatttttgtttttaaatttatatggtattgataaatttatttataatagatgaaaatttaattttttttccaaagttaaaaaaagtgcatcaatccattaacttcatctattatgattaatgaaaaagtctattgtattctacatattcaaaaatgtattttaaatatttaaggataaatttattagtgttttatttaaaatataatttaattttcattttctctttttttttaattattacaaacataaaattataataaatatgtaatggcatgctaatgaacccaaaaaatggaacagtgtcattttgttatcaaataaccttcttttatttttaatgcttaattgtataatttataatccaaactgttattattttgtaaattttatcggctaattttttaatcattttatcatcttgtcttcaattttcacgtattttactattcgtgttttttcacattttattattatatttttaacaaaatgacgtcatttttcataaaatagtaataaaaaatttaaaattttttagggacagatcaacactaaagtgtacaaaaattaaaaaaaaaatacgataatgaagcgtgcaaataaaaattggatggtaaaagtttcgaagtgctgttaaaaaaaaggcttgaagttaaaacaaaaattggaggtcctttttataaatttataaatacatctgaattgacagagaaataatataaagattataagatactatataacataatttgagaaaaatattgaattatgtaacctacttgtgtaatctatattatttattttcaatgttgttttgtttatgcaatgtttatttttacaatattttaataaaatttaattgaaataattgattatgtttttcaataaattatttcattaaaagacaagttcaaataaattgttaaattttcaaaatatttttcattgtctcaatgttaagattttgacataaaaataaataaaatatatgaacataggaaaacttataaaactcatttaatacttttttgtttaattgtacattttactacttcattgtaacaattatttttcacttagggtgcttttaatggatacaacataagaacaacacaagtcaagttacaagataattttatcttatatattatttgatggaaataaataaaacaaactaaataatataaaatttactgaaattttctttttaatattaaattatctaggtactatctatataattatgagagcatcatagagccctaggccatcttcattcaacccttcattacagtactgtatcctgaaatgggtgaattttcagacattacaagtgtttatgtgccgttgagagaggcaatttaaaggatgagaacgtagattttctttttttgaaagtgggaccaaaagagagcaatgtaatttattatggttaatttgaagacatttcttcagcgacttttccatgtgtacaagatgaattgcttccttattagcaaatatatatctttattttgtgaagatagaccaaagtttatgttaaagtgcaagtttatttctgccactaatgatggatgataatgttctttctgtcaaaccaaaaggaggtttccactttgaactggaaaccatttttcattatcatctgaaagatcagaacactcttcatgaaaccattttactctagataagccattttaaggaggaaaggaattgcattgacctcactgctttggttttatgatcaacaacacaagatatatggagtcaaatgttttgtcgagtggtattttccattatgaaagctgaaacaaaaaggaaacattgtaacagtattgattagagaatctcgaagagtaggcaattatgaatctggtaacaatcttgtcattctattatcaatatctattatctaatactactactcaataaatcttgaacatgcaaaaatatgtaaccgttttgatctattttcataaggatgccaagtggcatcattaagaaattttatagaatgattctcaaacttcattagcagctgctttttcattcattgtccttttctgtaatcctctactgttttcaggttcgttttgtcagctacattccccatgctcgaaaaaagtctcttttgaacgttgttgtcttcccacttgtatatgcctctttgctaaaacatcaagagctgtaactacgtcactaatcaaaggtcgggtatctgcttcctcctgaatacacattgctgcaactgctattgcttggtgtagaccctttgttgggtagttccctttcagcaatggatcagccattgatgaaaatttccttctgtctttgaatagtggttgtgcctgaaaacaagaaacattatgaatgtcaattgctgaacatttgtgcatattaatggtctaagcttaaatttttggactagttttcatattgattagagggtaaaatgtgttttacgtccctcaattttcagtcaaagttaatcttggtatctacactttaaaaaccatgattttattttttatagtcatctctctttatggaacatatgatactagggtcagagacgaaattcaccaattacaaaaaatacgatgaccaaaattattatttttaaaatatggggactaaaaccaattttgaccaaaaatgaagggacttgtgatacattttgcccttgattagattataaatcctgaaattttaggtcagagaaatatgattttaggcacataataaaagcttcatgacatacccaagagaccaagttttgctcttcagatggtcttgactgatcaattgctcttcttcctgtgatcatctctagaaacactactccaaagctatatatatctgattttgtagtcaattgacctgttgaggcatactcaggtgcacagtagccataagttcccatcaccctggtggatacatgagttttatcaccagttggaccaagctttgcaagtccaaaatcagagagctttgggttgaagttttcatctaatagtatgtttgatgctttgaaatcacggtatatcacaggcggatttgctacttcatgtaaatattcaagtcctttagctgcacctgctgcaatgttcattctagtacgccaatccaaaggctttctgttcggaggtagttctgacaatcatttttcttttcttgttggtcagataacatttaacatgcttatcacaaaaaaaaaaattaaaaaaataatactagggtaatgttttgaaaaagggaacttccacggtgccagtcttgcagatatatttggtttctcacacaaatggaaagataaaacataatctacttaaaaccatcaatatgcaagttgttttatgttgtaactaataagtaataaccatgatgatccaatgtgctcatctggtcacactgccactacagactacacttagtttattgcatttattgaagtttgatactcaaattggatgttactctcatttttatccgtgatgcattgcattagaagacataagaagcatttactaaccaagaaggtgatcttctaaagagccattcaccatgtactcgtataccaaaatcctttgatcaccatctgcgcaataccctaccaaattgacaaggttagggtggtgcaagagactcaaaatcaaaacctctacaagaaattccctgtttccttggaatccattcctattaagtttcttcacagcaacaacctgcatgaaaggaccacagcatttagaagttttttcttagcataatattcacatagatgcgagttgaagttatacctgatttaggcttttgaggcgtcctttgtacacccttccaaagcctccttcaccaatcatattgtcagggtgaaagttccgagttgcaacacatagctcgtgataagaaaaagtctgagaggtaatattccctttcccaatttttgctatttcttcttctatgtacttccgtttgctggtatctacaagataactttgttcaagttttaagcatcggtattcatcattgagaaaaaaaatgtctgacaaagctgaaatccactatatagggcactataagaccactttgcacctttagcttagcaatctattgtaaaaagtcaaaactctagaggttaacaattgagacacaactattgaggtagagtaagagatccttaggtttatgataccctaattggtaaggataagactcatagctcacaaggatgtgagtttgaatcctgttgtcaaaatgataagacttcttcattggtacataatctgtaagaacttggtggcacaaattgtttcaaaacatgttatcaacaagctaagaacatcattaatgattaaactaggaagggagcctaaagagatgcacgagaatgcatttcacatcgttgaggtttcataataatcaaaaagttgatgaagcctattgtgatggtataaacctttcatggatttcaattttaggatttcatgttgagataaataagattgtgctagaggaaaataatttgtcgtggaaacaacattaaactgtagatatgagacattaaattgaaaaaatgttggcccgaaaatcgatacaatgagaaaattagcattggagcttggaaaaataccagatttaaaacacatgttggctaaccatggcagagcttttgcgtgatggtagttcttactgctccttttcaatgagttattgtcgatcttctcttgtgacgtgcaacatgaaaagaaactcatcttccactcctaaataactgatctaaccaaacccacatttacagaattgcaagttcatgcatctgtttttcaaatctgtctcttagcatgcaaatgttagccaatgatccaatgcatgcagtcttagaccctccagaagtggtttcaaatcaatttaggaagtttttcattgaaacatatgccctgcagaaaccaaattgatcctgagttctagcttcacacaaactttcccatatggcatggttacttttccttcattgttattcaaaggccatagttaggaaaagaaatgaatgtcaaatatgctaatccaaaaatgaccgttagggagtcactcatctttaatatcattatctaaagttcctcaatataggatttcattaagtgttccctcttaggttgcactttattatgccaaccaaaatggagaggatcactcctttatgaaactagtcaagaataaattatgacaactattttatatggacagcttatatctactttgtatccttcctatctacttcagttatattctgtttgattgagcatgtacctaaatttgtgtatgatctatacaatacttctttaaactttttgaatgacaataaactcacttaaatgatatgatgagacatcaatttttttttttttttttaaaaaattgagtttttacttaaatgttccttaatataccaatctctttaatagtacttaggtggaatattatatgtattatattacattttaaattataattttccccatctacatatctgtattcctaacttatacaaaatataaggatttttttttcactttgattaaatgaatattttcttgtattcttgttcaataaaataaaatatttctaatattttttatccatacaaatcgaagagaaatagtttgaatttataacaacaactcatatattttattcaatcaatagagctagaatcatcattttaatcttacaaatattagtatgctattatgttaatccttcaaatattatgaatctaaaatgtcactgaattcttctgtataaagtggtgacataaaattagttatttttattttttaatacatttaacttaccaaatttttggaaaaaataatatagcaatactctaatttttgaaggagaaaattaagtgtttagtttttttataaaaaattaaggaaagaaaagactcactctgtacacgttccaaagacaaggtacactaataaaaagccaattttgcaaggaaaattaatagttcagtcaaagttgatgttataacaaaaatcacagattccagagaagatattctttttgaaacatgcagtccaaattcaaaaattatttggaaaaaaaaatatgatatactgttaaacatgtgatatgccgaaaatttaaagttatatttttgttgagcacgtcatttttggaccaatatatattgttaatttttcatgaaaactggcagagggcggggggactgagattccaaaaatacagcaattgtgattctaattcctgttagatgaggtatttacatttatgctctgttcggatttggagatataaaaaaaaaaatgagagaagagaaaaaggataaagaacaataagattgaaatattatattactcggatggataagtacaaaaataaagatgaaatcgtgtatttctggggtgggggagatgttttctgccatatgtatcattgttagaataatagtaggattaacttttttaatttttatgtcaatttatttgtcactggctgctataatatgggaactaagaaaaaatgatttaatttctctaaaataagatttctctaaagtgaagaaatgcaatttagataatgaaataaatacattcacaattatttattagaaacatcttaacttataagaacttttcaattgtaatatcttgttacaagttttttaattaagacaaaaatgctgaatttctaagtttataagtatttaaaaaagaaaataaataagattttttaaaaagaaattgaagtatacaagttaattttaatttttatataaaaaaatttaattcactttacctcattggtttattttatttcgtcttttacaagtatcaattcaaaatttcattcaataactaaattaaattaaagataatatttgctgattttgcgttccgtcatacgactctttttaccaacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttcttccccattattgtaaccaaaaagcttcatctttgatttgaactgatgaaatcaaaagcaataaaacatagctagctccaattaaaggacctaaaatcgacaataatcagaagataggttcagcaatctgttcttagattagtgaaagcttgccctaattatagtttctaggtatctagatcacctactgaaacagaaactgtaaatgctacacgatcaggacattaaacatggggaaaaaattgaattaaattgcacaaagccatcgtgataaattttcaggtctttcattaacatggcaactttttttaggaactcttcacctgcctcaaactgtattgaataatgtatttatttacaattaaattcaatggtatccgttagcaataagtgcaaagggaacttcaaaaaaaaaaacaataagtgcaaaaggggaccatatagtgataaacaaaaaccaagcaaaaagggaaaatgtgtcttcaagataggcctcgatcgacttaataaccttcatctatatatgaacatcaactcctgtcctaaaatacggcactatgtggagcctaaatgtggtacaattggtggactgtggacatatatataagactaaaacataaaaatgattttaggaatatgaactggaacgacaatacttctgaaaagtgcaatgctaagtaaatttaaagttattataagccttcaaaagtaacatctaataatgacacaaggaatccaattataaccccaactaaaaggatttcaatttgctgtgactgtgagacgactatactcacatggaattagaagaaatggctccaattagtcatgtataccttctaaatctctgccagggcttgacttctcttagatttaattgttttacaatgaggttaagccattattaggttttaataagattggcacttggattttccttctgataaactctaatctttttatcttacattggatataatgctcacttgtatattaattttaccgaataaaatctaaattgtagattacagaagactacttttgttatggtaaactgattttcagtagcatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaactaagtactaatttaactattaaatgtgcctaatttcttcagttgaatctgcataaaacaccaaagttcaataaactttctgccaagaaacactaactcctttgtatcatataattcaatgcatgtgcctagctagggataatatatatccatttatttaagtataaaacaataaaataaaatgtacacaacataatactaatccaatcaaatattcaataacacagttttaacaaaacgtattacaagaattaagctttttctctaatagccaataggttctatagtgaatcatttctaatggttcgatcgtacaagcagatagcacaaacaatataaccataaattaaacaatttagtagggtgtgccaggcctacactgtattgcaagaaataggcgacacttgaatacttaaaccgattagaacagatactacacttgatcttagcctaaaggcggagaaaggcatgctttggttattatattgttgttgcttttatttctgttacatgttctgctgctttcttgactaactgatgtgggactctttggcgactacgctgctgttgcaaacttgcaatagtgacaatttgaaatgttagttcttctaatccggtctttcttctaaatgtgttttcttatttaggatgtgacagtgcgtacaaagtccaaacctagtttgctagctatgtgttgaatgtattaagaccttcatggaactactgcatgcactaaaggatgctatctgagaagttaaaagggataggatgactaatttagagacaactcattatattatggattctgttgctgggccatatccataccctgtgatggtaagagagtttcatgcagtgattgacaaggaaaccagaaagcaagctttggaaaaatgcataagaagccaaatgtgtgtgattgcatgtgttggtgacaaaaaaagttaggtaaggtgtgcggatttagcttggataattgcaagtatgcagcaatattaatttcagatatgtgatatatactaaaggatgctgcctcagaagttataagggatagggtgactaatgtagagacaactcattatattatgtttctgttgccgagccatatctatagtactataccctgtgatggtaagagagttccatgcagtaattgacaattgacaaggaaaccagaaagcaagctttggaaaaatggatagatgaaccgaatatgttgaatgtgcaagttttttctctctagaaaacagcttggtgtcgaacctgaacatggctttttgaaagatttagggcgcactgaatatcaaagaatgactggggaagcgttgaagagggtactatcttgtgtgaattgcttattaaaaaaaccaagtactatatttgaacatgtttaaaaagtaaaagtgcatacatattggccaggactgagtattatatttcaaactccttatttaaaagataagtgaaaagaaatatttccaacaaaggggtgaacataataaatagaaaatttaaaaataagcattgaaataaatgtgatctgttaaccaaatgaaagaaaaatcaaaatgccatcattctgacacaagccaaaccataatagaggaggctaccagctgagcaacccagcaaaatagagagagcagttgatactctaatgtagtcttccactacaattgcaaattcttttaataactttcttgacaccaaaacatggtataggtatataattttgtttcataagtatgtggggttaaggatttgaattcgatcttttatccctaatctatatgtatttaaaaatatatgttaacaacccattaaatagatctcattatatcaagaaaataatcattattttttggtattcatactgttcacaaatattatttttaatttgtttttttataatttaactcataataattttcacattcaatccacaaatgcttattacaacaaaacaatatagatagaatttaatttttgaaatgaattgaaaaattcaacctgtatttcaagattttttttcattttaaggaatataaaaaaaatacatcatgtttttatcattattatgatatttcatattccaattcaattggatgctagaaaaaatgaatttgggatagtaaagaaaataaatattttaactacttttttttaataaaaaaataaactttcttgacgaagtttatgaaaaataataagcaattaataaattaaattgtttatccaaatatactaattgcttgtgtaggtggcttttctaacataaacaaggctcgaaggtcatacgctaaaggttggaatattggtctcttcaaaattttaaaaaacaaacaaagattgcacaattcacttttacattgaaatttaaagagaaatgttatttttagtatgacatcattttttttttgcttaacagcattttatttctttattataattaatatgtatttttttacaaacagggttttttacttgaatttagtttttttaattaatacatttagatcttcggtcactttttctttacataaagttttcaagtccttgtttttatgcaaaacgttttaattttggacaaataagtttataagctattaaaataatttatagacaaattgaaatgtcttattagacccactctgaatattttttatttcataaaaaaataagaattaaacaaaaattgttctaaatataataagtacatttcttttcttttttttccttaacaaatgtcataataagaacaatcatttgcatttggaaaatgtaattaataaaaaaaaaaaaaatttaattggtaaaagaaaaggggatgaagttaattgataagatatgtattgtgaataaatgttattcgtttgaaattaataggaagaatgtatttgtttgatttgaaataaataagagtatatctgcaaattaaaaaaagtataggaagctttctcttttatatcagagcctggtttcgatccagggacctgtgggttatgggcccaccacgcttccgctgcgccactctgattttagaaattattaatatatatttcattacttgtacaatattttgtgcagagtactgttttctttctttgattgaagtttttgtgcaacgtcacatagcaatctactacggtcaccaattcaccaaacaattgcaactttgacgcccacgaatttttttgtttgaaatttattggatggcgtggttttccaaactttttagattttccgtctacttgccaaacttgtcacgacattgttgctaagtaaatatgttccttgcacgattagccaactgtgggagcagtattcggtaaacagataaagataattaacattactataagatataataatggtataaagggaatataccaaacttgaaaccttcgaataaatctttaatattctatttaaatttttttaaaaattaggctaaatagtaattttttatatgtgtagagtattcacaaatttatccccaaaaataaaaattcaaaatttagtttttgaaaattaaaaaatgtaacaaattcattaattaattaactttcattcattattaatgaaaaagtttctgacatataggaaagaaaatgtcataaaatgattgttaacatatatatttgactaaaatgctattaaattttcattggatcaaaatatcattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgcttaaagaatttttatataattaatcaatcataagttattatatattattaatttgtttttttgaatgcatgtactataaatttgttgattttaacaataattactttaaaatatacttattacatttctaatcaattaacactgtaaacctttttatactcacactgtacaaaaattgaacagaaaatttctatattattaattaattaaaaatattataaatatgagttttacagtaattataatattcaataaagttattatacacgtacgttaatttatatataaacggtagtataagaacttttatattattaatatattttaattaaatattgatattataacttataatattgaatgactgatccattttcctttcaggtgtcctcaattaaagttcagaaagtatgggagtcagttggattatgacgagttattaaaattaaacaaagtgagagcattgaaggaatttatgagttaatattcaatctcctggcatctctagatagatgttaaaagcaattttcttgttattttatggtgcatttgaaaaaggcaaaatgagaaaatatggaataatattgagcttcagccacaaatattatcagtttttatggcattgcaacacttttctgaatgcatggaagcatgcgtgaagaatcacaaaggacatcaacatgcatgaaaatgatgtcatcttgaaggagcataactattatggggttgttatttatctttgagataaacatggtcattttatcaaggtgaattctacttgttggcatcatggaattcctaaccctcgtggagcaaaagcatggcgtctcttacaaagcattgatacgatcaaaatagctaatgaatagtaggttcaaaatatataaaattgaaaagtataaaatatgaaaatataaaatataaaaataataattttaaatatataaaattaggagaataaaatataaaaatattagataattatatataattttttaaaataaagggtgcatttgcacgtctcacaataatatacatttaatagtggatatggaagttcaaaatataccttttatatctaacaatcttttagattattaatattttcagattttcacacgttttatttaaatataaatcttatttattttaattttttggtgagttttttaaaagacaaactaataagttattcactagttaataagaacatataaattatatgctagtgtttatatctttgatcatatactcaattatatttattttcttattatgaataaaatggcatatctctctttctttttttaaaaaaatattacaacttaaatttaatagatatacacttttatatataggcaattaaaaattatcattttaagtatttgatataatttttcataaagaacttgaaattcagatttttagttaaaaaaataacatccccttggttaattaatcttgattagggtccctgatgaatgacaatgtaaaaatttactattagtaataatattttgtaaaaaaattatatttatttatttatttttataaattcaaaatttttattttattttataagaatattataacaaatcatacatttttattcaatcaactagttaaattcacctttaattttaattaagataaacacgaaaaaattccaataatttgtatgccaaacaaaatagagggaggagcaaagtatgcatagttgactctcgaaaaacattcaaaagagtttcttctcctttcttcgatcgtgctcgtgccacggcgaagatgaagatagcgtggcttctgctgctcctcctcgtatcagtctgcgtaacgggctctcaagtttgggccctgaaatcgccgtttcacccgcgagacgtgcttcctctgctgcccagacaggtgtcgtggcccatcctcaaccgcctccacagagcggtggatctcctccccgtcttcgtcggcgccgcctcttcgccggacgacagtctcaagtggaaaggcgcctgcttctacgagaacaaagcctggatggtgtttcacaacaagagcggctctcaatatggcggtggaacccttcacatcaaggtcgcttccttctcaagtgtgggaatggaaatctatgtcacttctttttgttgaaaaaaaaatcaaattttatgataagcattcttgttgtaatgaacttttatttaatactaatcggtgaaggactaggtcaacttcgtttcatgaaatcttcattctgagtggttaacaaaaattggtcatactcttgaaatatttcgtagttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttttttttttttactttaaaaaaattgcttagggagtaggtgtcattaagatttaaagagtgtttttttaatattggaatgcatagattatgttatgtggttgagttgtaatttggtggattttggttggacgtgttgtcatttgaaagcgtattacattattagaggagactaagttaagtggatttaatgtcgctcagtattttgtatgtcattagagtaatgaaactcttactcctcaaatagggtgtatggatggaaataagagagataaagagaataaataaatagagaggaactgatagatgtggcaaatgatgtgatggaaaatgaaaagagaaatatgaagaaaaatgggatagatcatagaagtgagatggaagaaaagttgggtgtatgtttagtattttcctattagtctatgcagttctataattgtattctttttatccctctctctctctctctctatgtatggatttgggattcaacggaaactgattgataattatctatgtgctgatctaggttagcaatgctcacagttggacgtgcatggatctttatatttttgccaccccttatcgtgtaacatgggattattatttcctggcccgggagcatacgcttgagttcaaagagtgggaagggaaagctgagtatgagtatgtaagtgaccatctttcttctgtacactgtcactaagtagagttttttgaaacttgaaacacacatttttgttttggagatccttatcctctttgcaatcaggtaaaaaaccatgggttatcaattttcctcttgcaagctgggatgttggggacccttcaagcactttgggaggtcttccctctatttacaaatactggatggggggagaactccaatattaaatttttggagaagcatatgggagcttcttttgaagtgcgccctcagccttttgttacaaatgtcagtgctgatgacattcattctggagatttccttgccgtttcgaaaattcgaggtcggtggggtgcttttgagactctagagaagtgggttagtggagcttatgctggtcacactgctgtttgcctaagggactccaatgggaagctttgggttggagagtcaggacatgaaaatgaaaaggtaaaatatttaagttgcattatatctattggttctgtgcaagatttattatatttcatagcaccgttgtcagtatcatatgtttcacgatacaaaggcatacgattcgatttgagcagttggtgactcaattccttgagtgaaacattttgtgcttgaatcaccccatgaatagcaggaatcacataggaattgtagattgcacatgaatcatgtgattttggtgcaagcgaccgcacaccaaagtggttcgggttatgcaggacccagtttcgaactttgaagaaccctaaaattgtttttctttacctgaaaaattagtgaaaaagagagggaattggccaattctttccctctaatcaaccgcatggcagcccattgtctccttttcatgttttctactcattcttcttgtcttctactcttctttacctttcccaatctaccctacatgcaagctttgtggtccactcttatttagggtggtcatacactcatactgctgagtttgagcagctactggttttttgtccatatggctgttaagaattggtgattttttttttgttttgaagcttatgtccctttgtaagcaatttgacttcaaaatgctaacaccccccccccaacccccaaacacacgtgtatgttttaacttttaatatgtttccttatgttaaaatgctcctatgtttatgttttttttaatgaatttgtgcttttatgtcttttttagttgtatatgttatgttttattattaatcatacagttcaatttgctatctggaaaataggccttccggttcacaatttgaatctcaatttcactaccatgtttcatagtcatttttttttataatttcattaatatttatattttcttccttaagaaaattaacatttcttgaatcctatgcgatgtttaggttttgatataatttatgaagaagtgttttaagttccttaagttaccatgtcgtcatcagaatagcaagattatgctctcagtttcagtttgaaattgtgataaaaaattactgcatggtgattaccaagttaacatatatagattttcttttatgacataattcatgatggttgtttgattgtttgagcaatgatggtaaaagtatagtccatattggtttgtcaactccgcagcggcatttggagttaagttgctagcattttatttcctgcctcaccttttgtttgcagggagaagatataatagctgtgataccatgggaagagtggtgggactttgaactgaatgaagatgattccaatccccatattgctctgcttccattgcaccctgatttgcgtgccaggtttaatgagactgctgcatgggagtatgcactgagcatggcaggaaaaccatatggttaccataacatgatattcagttggatagacactttaaatggaaactatccaccccccttggatgctaatgtggtattaattcaatcagttgttctgcttaaatttcaattcatctgtttcattagattcaactatcttgagtttttgcactattatgccatgctttagcattttttacctacaattttctagcaattgtatgaaatatttcaaacagagaattatataaaccatggctttgatcttgcaagaactcaatgagctttctacttaagttgcttgaatagtataaagttttgcttgaattaccgtaccatatgctggtttatgtatagttatccgtctgccatccagaaagaccattgctattgaagaaaatgttatttcacataaaaaaaaagaagtgatgaatgtggtatcaattattgattgtttgttttctctatcttctgccctttctgtctttttttggtttagccacatgctacatagcttaatgttttatgaatgagcatttacttttgttgctctgcaggttgcttgcgttatgacaatttggagtcaacttcaacctgaatatgcagcaaatatgtggaatgaagccttgaacaaacgacttggaactaaagtatgctgcaatcttttttcttgctccaatacacacacacacacacacacacttaaaaaaaggagaaataataattttatttcttgatcagaaaatgtattataattaatgctgaaatctcctaaatgtggaaactaggaatttaaataatacgcacagctacgcgaataattcacatgttacaaatgtataacaatgtcatcaatgtgagacaacaacactctcccacaagttggtgaatggatgtctacacacacaaacacacatacatatgtgatactaaacatttttgcttatgctagtaaattgaatcaatgtcttcaattgtctagcataagtcataagatgcttgtgatgtgatatattgcatagattagtaagcaatcagcaatatagaattccacattagtgaaaaaaagtgaaccatgtggcccttttgtgtttctacagggacttgaccttccagaagttttagtagaagttgaaaagcgtggatcatcttttgatgaactactgacgattcctgaacaagattattggacctacagtgatgggaagtcgacttcgtgcattgcttatatacttgagatgtacaaggaggctgggctatttgatccaatttctagttccgttcaagtgacagagtttacggtgagtttgctgggaagtttggtcttttgaattgcttgcaatattatagtaacttttgaatttcatcctacacaatttatacaaatgattgagcatatataatttcttatcatggttgtatagatttctaacaaaatcctttacaaagtgaaatcaggttgttgagcaggattgatatcagttcactacatatattgtttgtgtttctagaagtcaaaaacactttacagtagtatattgacctggcgcatatagacttatttttgtgcaataagtgcagataaaagatgcttacattctcaatttttttgagaacaattctagtcgcttgccaaaatggtgcaatgatggagacacggtgaagcttccttattgtcaaattaaaggcaagtatagaatggaattacctggatacaacaccatgcaaccataccctcatatgaatgaaaagtgtccatctcttcctccaaagtactccagaccccagaattgctagcagtcttcaattttttcctacaatcgaagggctgattgcgtgtgaccagattttttggtcttctagctttggatttcttaggagatgccaatgaattattgtttgtatccatttaatgtaaaaagaaattcaaacaattcgatatcgtgtatgtatttattattacaaacttgaacttatattagacattcatgtaattcggattatctatgtagccagattcaacagtgtaaatataagggacttgaatatatgtacatcatgcaaaattaactttaataagtgctatgtaaaatattttgtaagtcttgcatctgcattttttctctctctctctaaaatgggtttggcagctttgaattgagaacttcaaaaactgtactgagttgtgaaagtagcaatttcgttgtttagtgtttactccaattcagcactctaatgtaagtgttacctgcttttaccatttaaagaacatagacatttgcagatagattaacgcagcgcaatacagatatatcacttttcaaatccggtataaccatgtaactcggaacattaaacaaaggtaagttttctaattttttatttgttttattttatggtcggtgcaagagaattaatcttgcatggccattcatgtgcactgttttgcacacatttccatctttttcatttcgcttcctcttctctttacttttttcatccccatttgatctcttgctcgacctcttgctttagcattaagatttttatactctaatctaatgtagtatgtttatgctctcaattacttctctttcttgctttatttttgctctctcacaacactattaatgtctatcattttatatatgtatcaacgtatatttaagttgtcgcagcgaaacatcttttagagttgtctaaattgaagaacccttaccaattatatgttttttcacttgaattgcttcaatattgtataatttttcctttgtatagggtttttaatggtcttagactcttagtgttctacttgaattttttcatgttttttttttaacattttgtaaagtattttatgaaactcataacagtacgagaaataatattcaaaatacaaattaatactttttaacatttcggaaagtactttcttatatgtttaaaacaaaatattattctagaaagtacattttggaataatggttatgtaacaatgttatgggtataaagggtatagttgataacaaacattaggtttaaatattttttcatccctataatttaacattttttttgccttcactcttaaaatttttgtttcattttagttcttgcaattttatttttaattttcgttcttaaaatactttatatatcactttgaatagtaaaaaatatattttaaatagtaaaaaaagtgttatctaaaacactttgaggaagaaaaaaaacacattttgcaagaactggaatatattatttttttcaaagacaaaaatgaaaaaaaaaatgctaaattgcaggaatttaaacctaaaaattaagaagaagagtgcctctctaaatatgaggtcctgggtgatcgcccactttgactgtatttagggccatcattacttaggcatgcatatttgaagtcaatggttataattgatatatatgtgtgtgtatataaagaaagctatagaagtgtcttgataattctagatttttctataaagctatagtagtcacatagataatagaaatgtctcgatagttcttaagttaggaaaatgctagaataatgtataatattatttaataatccacccacatatgtagtcagtgaagtgttgcctgtaaatatggaatctgcactctgttgtagtgtgcttttttgagagatcaacacaagctcctccactattgttaagagctacactgccaattattcactattacacttctatacaattcccttcactaagtcaattattactaacctctctaaagccaacgtcaacagccattaaacaatcaatccaattttcttattcctaaaatactaacagtactagtggttatgactgatgagttgatatgggtgagaccaattttgtaggagatggaacttgctaatacttgtcctatgaaactgcggggtgatcacaaccaagttgtcatttatatcatcacatcaaatctagtctttcacaaaagaacaaagcatattaaggtagattgtcccttcatctgagataaggtccaacataaatcttatatctacctcttaattatgtcaagacagatgaccaactagcatatgtatttgcaaaagcttttaatgaagtgcatagaaatttaatttgttacgagttgggcatgaaaaacatttatactcccgtttgagtgggagtgctaagagtaaagttttagtctgtatacggtcttgacctatgtgcttgtatatacttaacctagtaatataaatattaggtaggagtagttattcattataaagtacccaattaaagtttactcatatacccctctatctctatctctctccctctttcacttctctctacaaaatagaaattaaagcttactcaatatcaggtcaatctgatacacatgaagacaacatacaccaaataaataaaactaaaataaaaatatctcagacaatggactgccatgtcttccaaactttggctggtgttatcagattgtgtttcgggagattgcatggaaagcaaaggctcatcatggattgagaaatcgacctctcttacatcaacatcaccagatgttcagggatgtcatacttttgacaaacaatgggtctacaatgccatattatacatcatcaccatattatacaggctttatgaaagtcaaagaatatgaaacacatacaacaggaagcaatttaaggaagactaatcaaaattgtgctatatattttcgttcaaacacaaagatgaaacatcaactctgctgctacagaaatttccacaattattattaatcctaacttttcttgaacaatttcaaacatgactaactatgtattcaacaatttcaaacaatgtaaatgaacatatatcaatataaacaatcatgctaattttgattcagtgttgcactgcgtggaacctaatgtcgctgattgatgttgtgagggactgaatgatgcaaccaaattctggtggtcaatgcggtgagggacggggtcttgtaaggtaatgtcatgaatacttcttctttggcctctattatcggaggactgacgaagaaaatacttttgggcatggctagccacctgagtaggagttcttgtcttgacaacctttcttgaaatgtttatccaatctcccttttcatataactcaagtccgcggagaaacaacctacatattggtataaagatttaaatcatgagagaaaaacaatgaaacaacaatattaagaaagaagacactcagagagacacaaacagtacatgtgttcttcttgagtccatctcctgtactcacgggatttccgtggaggaggccgcgagtgatgattgatctgagagcttggaaattcaacctcggctggcaacaccggaatggagatgctgtgaagaaacggagtgagagtgttattcccttgatccgatggagacgtggatagagaatgaccctccgacgagacgagtgcctccctatgatgatcttgaagctcattgctgctgttccctcctaacatcgttctcttctaccagttccaattcaacttttctcctttctttctttctttctttctctttctttctttcttcacccactgatgcagatgcagagtatgtgtgtctctgttctgttgtttcctttatatagggtttggcattagcgcgcgccaaatcctctttcctcctctctctgtctaacggctactttcttatcaaatggcgccaatgccaagagaagcaaatcttcaccgttggctaattattaaataaataagctgttattaaataaaaacaatccatgtagacatattaagattaaatatatttttggcgttacatgggatacactcgagggtatttgctaaagtttaattttagtagaagggcatcaagtccagaacttttctagatttctcgagcttctacgatcgtgaagaacttgccaactagtctagaatcataacggagataattcctattgaatatgaggcacaactattctccaaggctttaacagcatctccagcggcaattttaggtgggttgtttcttcttctttctttttttttttgacaggataggtgtgttcttgaagttaagaattgttcttaactgagttcaccattggacgaggatgaagtggatgcaatatgtgagaattattcgtatataagaatcagtctttttttttaacgaatataaacagaagtagcctttatcatccaaagctttgagcaacttatggaccaatttcctcaattcaaagttgaattggttattagacaagttaatgtagttgtccatttgcttgcaagggtaactactgttaatgttagttcccatgattataatcatattccttattttattcggtctttcatcatcaataatatgagctcattccgttttatgtataaaaaaatcagttattaaccattaaaaataattaagagatgactaattagacccatttaaaaaaaatacaaaaagtgctaacttgtgagatctattttaacccacgttactattgaagatgttttaacaatatgtttataaataaaatttagcttggtactcaaagctataaatatatttttcctggatttgaaaacatatcaaaactatttttctcaaatttgaattgtggatataccgcaaagagctcatgtagtattttcatttttgagcaataactagcttattttactnnnnnnnnnnnnnnnnnnnnnnnnnnnnnnnnnnnnnnnnnnnnnnnnnnnnnnnnnnnnnnnnnnnnnnnnttagaattttaaagggaacttagaaagaatcaaaatcaaagcaacaatgaaaaacatggaaagatgaagaaaatgagaggaaattgggtaattcggtaggaagaaaggggtagagacactattttctttctttttattttttaaacttaggacttatttgataatcctttttctaattttgaaaataaataaatgtttgattatgtgttttttatcaataaaacttaacaacttttttatttaattcttattttgttttctaactttaaaatctgttttaaaacagcctcaccaaataaactttatctcccttctttttttcaaaacacaattttcaaaaatgattttacaaattatattttaaagaattttcatcacaagtttaatttcatggttagataagcacaacaagtattagctaatgcaataagcaaaaatttaattcctgggaggcacgcgttagaacctgatctagttgttgacaatgtaatttattccatatttaaagtagactcacaccaagaaatgtaaatttgttgaccagtcaaataaaaaggcttgataaatttcaattggaatttccatcgagtttgtcgagtatgcaacaaataagagccagttttgaatttaagcaacctcagtgataaggtgtgctaagctaagagaaaaaggaaagtagaaaataaaaagagctgcttagagagtgatgaagtactggcccaattctcctacgtgtataaagacaacgacaacacaacattgttccatactttgaaatcactaaagtacaatgatatatcttaaccatctaaggcatgcagatcaaccaacatatctgtattatagtaagcaaatatatgatatatcattatatcatcactcagccttggtggggagatggttgccgccagtcgctaatttgtagagataaaacagagtcatgagagcactgcaagaaaaagacagacaaatatcttaactccatatacaaactacaggtgactgatgtggagcaattggacaaactcacaaaacatagactaagtaatggctgccagtgcttgattcctgacttcaaattcagaacataatatatagatcttcaaatcaggaatgggaagttaaaaacaaattttagaactagcagaaaacaagttcaggataatggcacataaaaatatttcttttattctcaacataaatgggaatggtgaagccttgatcttttaaaaagagtttaaagaactttcatggatgcatttacttttaagaaagacaagttcaaggatttataatctacaaactaacaacttatccaacaattaaaacttaaaagtttaaatttagttcttacaactctgagagtaaaagtaaaactatgtttacaatgagtttgggtacttctaatcaatcctttgattacctgattccagcaacaagaccagcaggcataatcttggatgtttccaaatatcgctgccccatgacccaagttagtatggctgcacaagctgtttcacagtatacaaattagaaaaaaaaagcatagaaaattactccggctaatatggaccataattaactcagtgatcatggcttatcagattttatttttttttatccatagaaatcgaagacaatgtcagggagtttacaacaactcatgcacccttgctcaaccagagcaagacccccttaatatcatagcttatcaaatgaatacagagtaacagacatacattccccgtataaacacagagatactcattgatcctatatatattggtagtaatttagtataacttatgacttactaaaatattcttgcttaattttgagttttgacatatgataatgcaatgtgatacatctatacccctgctagagtttctgtgcatactttttattactaagtaggagcaatgcaagtcattaacttaatgataataaacttgttatattcataagcattttaaatcaaaaaaattctgtcaagaaattttactttcaatcgaataatatttgttacaaacacatccccctcctttgatcttttatatttatcattatattctaaaacatgggcttatattcaaagctaaagcaaaaagctctagttatagtcttgtaggacaaaccatgttccacttcatcaactatactaatgacaaaagtgtatggggcaagatccaagtctgataaataagcaatggaaatttgaaaagcatgcacccaatatatcttgatcaggttacatacattcattgatgcttccttggcattcaatattgtgcacagacaccctctttcagatctatgtatcactttccctccatcaggtagacaccctattaacctatcctaacctaacctaacaaatccccttccttttaatagaaagtagtaaatgaaaaagcaccatcattcaatatctttgaaacccaaagagcatttaggcagagtttcgataaacatttcaacaaacagctaacgcaaatccagagggtaaaataaaatagatcagacttctcccacaagttaaaacaacatatgcatcttaaagttttcataagtcgatacttgagctgcattattttaggagaacatggaattactaatctaaatatcaccatgacatcctaagagagagaatccaaatccagaatttcatacaatccgaaaaaatgaatccaataaatatccacatctttccatcaaataacaaattctagcatagaacacgtttcagatccagaatcatcgagagccaggtcaacaatcacacgcaaaataataataataataataataataataataataataataataataataatgaaaggaaagaaattataggataccagtctcgaggaagagagcgaggtaagagttttttcgtttgccgaaggcattgagactgagatagccggcgatgatgagaagcaaaccggagccggcgcctccggcgagggaagcgatgctccctttgcttatgtaggcgaacagtccaccacctactaacatcaatccgtacggaatcgtgaagcagaaatcgtgcatttttctctccttagatgccttcaatcggaagaaagattggaactggtaagtggcgatgggagcttgtggaatgcacaagtcaaatattaacaccccacgaaaccctccacctgctccttaagaatcattcccacaatctaccgtctcatttttttaaacttttatgttagattttttcaaaagaaaattcattttataaaaggagttttttttttcattaaatcttaataaattacaatgacacctatttggtctaagggcatcactaatccaagatacctaagaaactcaatttcaatatcaggaaatatataaaatcatttatagtgatcccaaaatgtcatcatttttaagatactcacatgtaaattttctcaagaaaacttttttaggaaaataggttttaagaaaaacaaactaaatagagtagttttaaaattatttatatgttaccggttgtcacttaggataagttgttatccaaatggtactttgtgttaattttttattttgtagtatataagaggcatcgttttctaattttggttatacacttttttatatttacaacatttaaaaataaaataatcgattgtagatataattaataaaaaaaatatatattgatcgtcatgttatataaatagttttgaacataactctatttataatatataagtaattttttaaacctactttagcaaaaaaaaagttaaaaaattcacggtattatattttttaaatttttatttaattatgtttcaagttataacaaattatgacacttaaaagtctttaaatatgtttaaaatcttttaaataaattatcaaaagttattgatataagtgatactaaacttaatcctttttaaataaggtattcaatttgagacttgttaatgaataatatttgattgagaggaaaaaaatttaattaaagacaattggttaaatttttttgataaaaattaattattattaataaaattgataaatactaataaaaagataaaaaaatttatccaaacaattttttacaatttttaacaaaagaataataaaaaatatcacgtcatcacttacaatattaaactcttttggaaacaaagaaaggaccaaaatattaaaggaaaaaaagtctggaaaccaagatccaagacccgtttccgaaatattgaaagataaaattgaaaaaagtttaggaattaaaaatattgtttatcctttaaaattcataaaaaaaaataaaaatccctattcaaaccgttttagggttttgtgtagcagcccaagctaataatggtggcttttcttggtacccgaatccagagcatcacctggttcaggttcaacccttcacacaaccacaagctccttccgcggagagccctggagatttcgatgtcgacaatgcaacagggccaatctaaaagacccatttgcccttcttgttccaaacccagccgaacgtgtctctgctctcgaatcctcacaccgggtctccaaaattctgtgcatgtaaccattctacagcacgcgctagagcgtaagcatcccctcaattctaccagaatcgctatattgggcctcaagaatctcaccgttgcaactgtttctgatgttaatttcgaagcccggttcctgattcggttgttggatccgaattcccattcgggtcatgctggaaatgagccaactgcattgttttctcgtcagtgttgggaaattggagacacccagaaattgctttctgagaaagattctaacttgattgatactgatagtgctggaaaatctggtttgagaaatgatgttgaagatgttctggattctgcttctaatgcagaagttgtgatacaagtgagtatcagtgatggtgcagtggtgaacgatgaagttgagaaaaatgtaattagtccaaagtgtgatttagctagaggtgtacatgaagataatggagagctagctgttactgttaccattggcaaatatggtgccattagctctttgtctcatatttggatgactcaagcacaatttcaatcccccaagttaagctttgacaatattttggcgtaccctgaagcttgtgaagcactctcaaaagggtttttggtgaagaagtttcagaggaagcaactgaatagggatgaagaattggaagaatgtgaagaatttgagcttgaggttcgtcctggatcggtactactatttccctctgataaggctgttgatgttagtaacctggatgctataggttttgaggtgaagaacttgatagttctggatggtacatgggctaaggcaaaaagaatttatagtgaaaatccttggttgaacattttgccacacgtgaagttggaagtgaacgagacaagcttatatagtgatgtgaggcatcagcctaaagctggttatttgtccaccattgagagcattgtatttgccctgaaggcagttggggagttgaatcatgagggtttggatggtctcttggatacttttgagtccatggttggagatcagagacgctgtaaagaggagagactgagcaaacacttttcctgttgaggtcctttcttcttttgattgaacaactcgaagaagttgcttcaacccaaaatagaatctatttgcaataaattatgaaccatgaaccttgtaagagttttttttgcctccatatcctttccctgcatgcaaaacacaacatgggaatcccagtggattatctgtataatgatatggatggagaaccccactccaatgagtttattgaaacttagcagattattgctgtgccacatctgctgaacgaggacaggagcagtctgagataaagcaaccagttactggttgaaatatgctaagagggtgggaatttgtatcgatgttttagcacaattatatttttaagattggacaatgcactgaatgatgtctttaaaatcaagacaattttgatgtttgtagtgttactactgctacatgacctgacctacatgtttacactgaatggaagacattatgtggattgcatattgctagagtctctcctcaagaaagaaggggagagcatgttccccaaggacttttggacagaatcatggctgctcatgcttgctgatttcaacttcaagccaagagacgttgcaagcatcaagctggaccattaatgattacagaaacctcagcagaaactgacactgctaaagttacccattttctaaccacttgatgatgatgtgaaatagagaaacaaaacaacatggagaaacaaaacctaaaagagaggaggaaggggaaaaatgttacctgcctaaattcaacagatacagatatttgtttagaactcagtttgtattcacactttataaaatcactgtgatggcataaatgtaattagattctatttagcagatttcatgtgttgatgtatattggataaatcagtttcagtacttcaagacagaataggccaacccagtagtttccacttaatgcttaattatccactctgctgtttttaccgttctattcttagattgctgatttacattctatcatatcccatttccctggtatcagcgaacaatgatttcagatttaaggcattttgttaattagaccttcgtgcatcccagtaatcttcatggctttactcgttgcatgactctagaatcataatctaaaatctcaatgtcagtcaagaatataaaacatacatgtttatttctggttattaagtacgctaagttttagttttcctatatagaaatcagaaaccaatcttataagttcagacaaaacaagcaacaccatcaattgcaaagtgataactagccttatacctcagtttactcactctgctgctagtagtgatacaaactaaactaaggacttgtctaatcatcaatatttacataacttttgctaatccacgtagttctgagttttagggcgtcaaaatgtcttctgatcaacgcatcttgagctggccaaagaggttatccagatatcatcagcttttactggttcatcatcatcattcctatgccaactccagaaggcatgagtggagtttacaatcttcagctcaccatgaccaaaactggcttcacggaattctgaccactttggctgtgggtttatatacctgtcaacaaacaattatgtaaggatacatgcagcaacaatgacggaaaaacaaatttcaggctgcatacatgataaacctcaatatagctttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataaaactcattatagctttttttttttttttttttttttcacataacaaaggattcagaaaacagatttctgtgggatgtttctggctgtgaaacttacttatgagctaagccttctctgtttcctccatcaccaatagttatatggacagcaccacagggatccaatcttccattatacacacgtttctgacaatgagatagagtattaaaacccagtttcaactaaatggtgcttacagagaaaataaaatgctaaaccataaagacatactgaacgttcataagcgtgaacatgaccagcgataactaaatcaacactggcagcataaagcaatggctccatagctgccatcatatcatcccctgcaccttgatgagccttgttactattataccatggcacatgaaataacacaagcagccaaggtgtccttttcctatctacctttgacagatcttcctgtagatgagggatgagtaaaaattaaagagtgaaaaaaaaagtggtccaaactccaaagtacttttctttttaaaatgatagagtagtgtaaaaaagacaaataaaaatagtaataacaagcatgattgtgtagttttccatggtcatgaattgcattacacttatccaatttttagtaactcttgatcaataggtgagatcaactaacctttagccatctgtattgttcagagtacacatcataatctgcataggagccaagcatgataacgtgaacacctgcaacttcaaatgaataatagagatttgaagttgatccactttcctcagatggcattttccatctggaattataggacacaaactcatccgttaagaatagtatgttctcctcttcatggtttccctctgtcaccatccacggccttgtactcgcaagcggctccacaagtttcccaaaattgtcccacagatgctgcatacaatcagcatatgaaaggtctcctggtagcaggtagacatcatatttacattggtctatgtgtgccagtgttgatttagtccaaccagtttgacctagatccccagccacagcaaaagtaattggaaattgagctggaggagttttgagctcaaactcgggaccttttccaccacatcggtagaagtacacagtattgtcttccaaagggccaattacggcatggtgtatctttcccgagctgtataacagatagttataagaagtgtactctccttcagctattgagtcatatctcccaggcaatgttccgtattctacatatgaaggtgaatgtttatcatcggttatccatgtaactctcatgtgcttgtctcctgccaaagaaatgtgtacctggaacaaaaatttggtatcaaagaaactgaaatttaatagtcaccataaaagaacatgcataaaagactaactaaagaggctgatatgattgcttaatagaggaagcacggttgacagttcacagaatatttgtcctagaattggcaaataattcatagaaagcgaaacaaactgttcaagttacataatattagctgataaataataatcattgtctgtacagatatatactataagaaatcaccaaccataacgaattaaaaatgtcttttgaagatttgtgactagaacccagatcatgaactataaatccaatacaagagtgacagaaaattattggatcaactttgaatttcataaccaaagaaaccgtgcagggctatatcttgaaccccggagacatgctcccatcgtcactgtcttaaaaatcatatcaaagacgatttctgaatgattaacaatatgattttttttattctacgtagaaattaaagtcaacaacttgaaatagagaataattttgaaaatatcaccctataaaaaaaaaaaaatgaaccctcccaactgaacaacataatccaatcaaaatacgaaagaaatcaggtactgtgagttgatcaagtgggaaataaataacacaaagtgggtaatgatatagtactatatatttatgaatatgaacatgatgaatgaaaaagagtttgattgacctgttgagggtaagaggagtgggccttggaaattgaatcccatgggatggttaaggttttacgaggaagagatcgaacgtattcaggcgtggcaatagcaaaaagaagcgttagaatcagaagcagcagttgttgtttgagttccatgataacagtaacagtaactacctggctgagacagcaatgtacttccgcttcaatctttgtttctatcatcacccatcctcatgacatcaccaaatatgtcgttgcctcactttttccgctttgtttcgtagataaaacgaaaccacgctttcataattttcttaacaattaaaatatatttttagttttctatgagttttattcctttaaaatctgaaatcaatattttttttttgttttcattgttcatttaaatataaataaataatatttgttaatttaattaattttctcaatactaaaagaaaaaatgttaagaaaaacatgatactataccatacaaatatatttatttcagtttaatttaaacaaaatcactgaataacacaaataaaatgaggaaatacaacataaaaactgcagatgtattaaattaggattttagaatattagtttggtataataaaccttttggattttacaagactttggatgaatgtagtgaattttaagattttgtaaaaatatttttatgattaaaactttgtagtttgaattttaatagatttataacatattaatttataaaatttgagaagattttatagatttacaaagttttaataacttcactgaatttttagaaaacattataggttattagggtcaataaaaaaaatgttactgtttagataaaaaagagtgtaaccaatataaaattttccattatattaatagttaatttattctgtcttcccatttaatgtttcttcacataatttattaagcctatctgtgataaaatcttcttgtttatgcaattggatttgaaccaaaaatttaaatttatgatatttgttaattgataatactgaaaataaagaatcatatgttaattcaattgaaaattcattatcataatgnnnnnnnnnnnnnnnnnnnnnnnnnnnnnnnnnnnnnnnnnnnnnnnnnnnnnnnnnnnnnnnnnnnnnnnnnnnnnnnntattatgtgtgattaaataaaagaaaagcctgatcaacaataaaaaaagaaaaaaatattagaaaatctcaagagtttagtgtaataatttgttgagtgttatactaaaaaaaatcttataaaattatccaaatttatgctgaaaaattcataaaaaaactgtattttttttaatactatataaggcttttttataagttataaaaattattaatgaagattacaaacataaaaatgtccaaatccatcccaataaatcactatcaataacattacgaacaatctcctcactgttgagagtttcaaacttaatcatgtgggtgtgcgcataaattatccatgtgcacctatgctggacaaaggtagagtcttgtccttttaatatagtattgggtccattgactcaaattttatttccattatatttaactcaacattagaaaacccaattttctaatatacacaattctttgatgaattaaacaatattgctttgtatgtttaatatattttggtgaagtttgtctaactgtatatttggttaaagatatgaacttacattttagaaaaatacgaatttagttaatttgctaattatttactcaaattgtatgcttctttaaagaggaagagagaaaaaataaaaagaaaaaatagaagcaatatttttttttaaaaaatgagaaaaagcataagacaaaatgattttaagatttttttttctttcaaaattccatgtctttcatttttcttcttcttaaattcaaaatttattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaattttatatatctctaatatatttttcaaatcataggatacattttacttaataatagattgtaattatatttaaaaataaaattattagagtatgagtatgagataaaattttaattattttgtgtctgatcaacatcaaaaaatttatactaatgaattattaacaattatataaatgaatttaataccatatcttaatttaaaattttaaaactcacatttataagtatttttttcatttatataatatttaacttttttatatttattcgatgtgagacttctacctatacttatatttcaataaaattttataattaaattaaataacatataaataaataaaagaacaaataaaaaattaactatttatttatatttaaataaaaatattgattaaagtggaccattattcagcctattatttattagagagaggaactacgtcgtttaggaagggacattaatggttggtaaacacaaaaaccctaaaccctaccagcagctcagcgcgaaagccgtaaatcaatataacagttcgttctctcacactcttcacttttaagttcttctgcagacagcaagaagaagcataagcagaagaaccaaaactgaaaccaaaatcaaacgtttaagcttcgttttggtacgaaaccctagcaatggcgtcctccatagcgtcgcaattagaagctatcagatccttcgccaaaaccgactctgaccctctcaagaggccactcactcgcccttccatcttgtatgatcccaaaaaagcggctgacatctccaccgaggctattttcaccgaagctcttcgaggtcaatcttctcatttttaatttcgctcttttcaacatagtgcaactaaagcaatccagtaaaccgaattaatttctcagtgattaacatggagcatattcttagaatgtgggtttggacctaactcaaccctaccccaaaagctagctcatagggtgaggattatcccccacttatgtactctatcttgacactatctctacacaacgtcggacttgggtttttcttaatacatatgaattacggtgctactttatattctattttcgtttgattttgttctgtttttcttatgtgatgcaatatttcaggcttagagattcttattggcatggatgagcggttcaggaaccataagaacgatttgtttaaccacaggcgtatagagttggatagagagttgatgggaatagaacagaacaatcaacttaatgtctccattgcttcatacttgaaactactttctggatattttcttcatacggccgcccttcaaacgcttgagtacttgatacgtagacacaagtgagctttcaacaatgtattatgaattgttttcttcctaggggtgttgtgttgataatcacatttcgcctctgcctagtttaccttttttgtgatttttgatgtggttgttttgagtttcaggattcatgtatacaacaacgaggatttgattttgtgtgctttgccgtaccacgacgagcctgaatttgttcgaatagtacagatacttgatacaaggttaggaagatattattatgtgtttttggtttggttgtgatgtagactactactggttggagaggcttctgatgtttctgttaatttatgtgaaggaatactaaatgggggtttcttgatggtgtgaaagcctctggtgcacggctgcctagaatggtcatagtgcagcagtgcatccgtgataagggcatattagacgctctatgcaactatgtgagtaattgttttgtgtttagttgtgaatgtggaagttctctagtggaatcaaataattatatggctaaggatttggtttcaggcatctccgtcaaaaaagtctcgaccttcaatgcctgcaattcgcttttgtactgctgttttcgttgaagttttgggtactgttgtgactgttgatgatgatcttgtaaagaggatacttccctttgtgagtcttcagcctggcattaagggggtttcagatcacaaggttagcttcctaggaaattattttccatgtattaaattttaaaactgattatagttgggtatcatactgtcatatttttgtgattaccttctcattagtaggcaatgtaattgctatcaaatggtagactgcgaaataaatttgctctacaatatccaccagtgtaatattattcatcacagataggaatagtagtgcataattttttatgttagtatagtcataaaatatgattatatgactgggtgaccttacttttagtgcttatttgatctgttgaaattatggggttttaggtatagagggagttaaagaagagaatagaagctttgaatgatattctactgattatttgaccttactttttatgttggttgtggtgcaaaaatttggagaaaggctttcacatgcctttccacgtttgggcttgcaaccttagggatattttttgtaagcaggggagagtttaatctctctcacctgtctggggggttttaggtccatcctgtttatggcacctttattcatgttttctatgtattagtgtgccataggctgggttttgttatcatggactgttttctgctttctttttgtatctatccttttttctcatatatataatatatacttttgctgatcaaaaaaaaaaaaaaaactgattattacgatgaattgccatgtcttggatggtatattcatgaaatccgaagtactaacccttatttatattaatcatagagcaatcctgagagataatggaagtataggaagactaatcctaaaacataatctaagatactctaacatatgataaaatattttcacatattccaacaatatatgtatacttgtgtatttgagctatgtttcttggctccctctcctgcatttttttgttgtcaaattgtccttatttacaattagcagctggaagctcactttcttgtgctttcttttttggttttctatttgcaggctggttctcttatgatcattggtttgcttggaaacaaaactgcattagctcctaaacttttgaatagtttgatacgtttggttgccgagattgctcgtcaggaggctacagagttgacagatctccattggtttcggttgtcccttattaccttaattagtcttgttcaggtactagtgtaatcctgtgtgcttgtgtatggtttaaacggaggcattaatccttttttttttttgggggggggggggtgtaattggtatttcatccaatttcctttcattgtgcaatatctatttctgaatggctatatttttattttaatttgttctgttggaattttcttagtctcaaaatgttgaaatactcccattgaaggccttggagatattaaaggaaataaggtagtcttcctcgaacttctcatcatatgcataatcactgtgctttgactgttgccttttctttatttatatttatgatttattaaatcccttttcatatagggacctggcaggggttttattagaattatctaaggagttcaatatcgaaaagtttctcctcgtgcttttggactccctgattgactgcaggtgtgtttcctatgattgtctttcaggagatatatgctttaagtcatatcttatagaagcttgtgttttatgctgattataacaataacacatttgcagttcttctgatgaatactgtcagcggactttgctatccttaatagaaaaagtccccgtacatggtcttgtttatcatgtggtcaccaagatcctttcaaattgtgtgaaattatcacaaaaagttagcgactcaacttcttccatgtcaggtgtgtaatctgattttgaattttagaatgctgatcactatcctgtaccccaaattatatatcctggtgtgcttcataaggttgatctaataattcataccaagagtgaatcaataaatttctaaagaaaataatatttaatgaaaatctcatttggtgattgagaaatctcatctaaacttctgtaaaaaaattgtttgaatacctgtgtgaaaatgttcttctgaattctgaaagcaatgaccatggatgcattttaagttacttggaaatttctttcaccatgaagatcttactttgtgtttgtataagcttattttggaggcgaagaaatttttttggcagcttatctggaaattatttcccccgacacagaacttttcaaacatgcaatagatacatgatattaaaagtggtctacttagcagttaatttgttttctatatcaatattatgtaagtaataaaatgtttgtccagactgtataaatagtaagaactggtgtttgaaacaccagaacaaaagcattgcattataccgaatgctgtcatcactccatttctacagtatgaaaagcatttctctattaagagccaaactcttggattacgctggttacaatgccttgttttcaaagaatcttactccattctttaacagtttaaccctgtgttgaaactgataaaagaaaattggaatttgatgttgaagtctaatgtgtgccttcaggaagggaagttttatttgttaagaaactacatactcttttttttcaactgtaaataaatagattaataaagaaacccagagaccatgaaagatacttatgaagacaggaaattgcacatactactgtcctatacattaatgctgctaacaatccttgttgataccaactctgttttggccaagtttgagtgtgaaactgctttaaagcagttgaatatgtgatttaaaacaaatttggtgtgttgtaaacaaaccctctaatgaactagatatcttcaaattgtgtatctcactatatggcttaagatttgtctatgtgtatcatgcatgcatgttatgtcttcattagtcagtgtactttgttttacttgcttcagcttggaaattcaaatttcttttgaagaagtttcgttgatttctgtgtaaattattattgtcaggttttgctcctgaataattttgttttcttttcttatggtgtttttttttttaatcatttagctccatatggtttgcctttatcttttttactagaaatctacaactagtcagttatcatttgttgcctagcttattattctcataatgttggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttgttttcttttcttatggtgttttttttttttaatcatttagctccatatggtttacctttatcttttttactagaaatctacaactagtcagttatcatttgttgcctagcttattattctcataatgttggtttgccaaatgttgattagttgggtgggcaaaaaagattctgtttgttgtcaatacaaaatacccttctgaattacgaggtgctgctcatcatttccttcaggtatgctgatgagttgtctgcttttttgttgttgtcatgcattgtcagatagtatataatggcttgaactttgaacatgttcaacaggataataaaggacattctaagaaagatgattcattgtataaggttttatgtaagatgttggatgggagtatggattcgtcacttggtatttcagactcaaatatttggttgggcctgtatcatccaaaggtatcaatcattgacctattcttgattattaggtgtatgtaaatataaaagtatgtattctcctgttcaacaatgataatttttttataattgtaagagcttcatgatttatatttgatatggtggtctaggctgatgttcgacgtgctacgctgcttgatttaaataattccgttatcctgaaaaccaaggcagttggttcagaggtatatatgctccgttaatcttctcgtcctcccaaaacctcatgtttccattaatttgtatttttttttttatgacaatgtttgaagaacatctttgatgtgctccttttggttggaaaaaagttgaaacttcttgcttgatgtggtttatttcctttatatatctgtcctcccaaaactgcatgtttgaaatttgtatttttcatttatgacactggttgaagaacagccttgatgtttctctttttgggtggcagaactattaaaattttgcttgatgtgttttctgttttgcacacacacataatgagggattgttttctgatgttgaccttgagttttattatttgtagtttgggcttggacccatgaatagctactgtgcttagggaccctaaacctatatatttccttgtaatctgagtacattgtaacgagtgtgtgaggaaaatatagagaatagttagacgtagcccacattgggtgaaccagggtaaacactatgtgttattttcttcttccttttcttctctttccgctctctcgattgttgtgtgattgcttggtaccaacacttacatcattcagtaactttttactggataaatttatcccgttacccattgttggattaaaagttcctatcatatctacagaattttagattaattcaatttttttatacatcattcagttcttcaaaattaatgttatatatacttctgacatataaaatcaaacccattcgattttcttcttattgttgttcatattttagaagatttgacatagataattttggtaatatataattataattcaatagttggcaaaaattacatttcataatgatgtaagagtaagtgtgatttacaacggtgtaaattaattcctctttaagtgtgtgtaatttctgatggtggtggcatattacttctctttgattttttatttttatttttaggaaatggttgcattacaaaattttgctgtcaaactagttttatttggaaatattttttgatacatttaagttccattttgaatgatttgaactgagatgcatttgtgatctaatttgtcaaggccactgattttacacattgttggtgagggagggtataattgatttttgttagaaaccttcatttgaaagagtaggtgtacaaggagggaggagtatatatccctcaaaagccacctcaacttcatttgaaccgagccaggtaataaaggcttagcaaaaagtgaagaccacagaactcaatattaaacctgatatctttacaacactgtcaaaatgcaacagtgaaacccctctgtaaactgagccttgaaccacgatgaactcaagggcacaaatctgtccaaaagaaagtgtggtggtggaaaatgctataaaaatttattgcatcatgtttcattgtcaaacacaaacaccaattgctagtaagaagtactcagtaccaatggtaccattatttagtacttggtatgctataattaattatatttataagccataaattaattgattatcacgtgggttatgctgtttttatgtgaaattatgggttgatttcatgttgacttagggaaatctttataatatggtcaaagttcttgctaggatgtgttaatactgttttgccatattcaaagtcttcaacctttaactaaccccaaaagtcatcttttttatcagaatcttgtaagcatccaagaggacatcttaagacagcttgatgataaagatctaacagttgttcaagcagctttacgtgttgatgacttgcgaaatgtaatagattcttctaagcttcttgatgcactacagaatgtgctaaaaagatgcactggcaaactgctgtcaggtaatttgtggtatattaaaaataattagatagatatcatctttattgtttctgcatgttgtattgaagcaatacataccatgcatcgatttatccataaacttggacaaggaatttgttctttgaatgcattcttgatggatgatgattgatgactgttaggggatggtggggttacgtgcagaatacagatgtggtctcataaatgtctaagcttccttaatgtgtttccaatggttcaaaatatgcttatgcttattcttctgtgtattttgggattgatttactctgttgaacttatattatttcccttttctttttgaagagtgtctgattgtccatttttatgtttattttatcaaaatatgcttttactttatgttgactagatacatataagcatataaccttcatttcatacacttattccagttgtgcttctgttactggagtatatttgtcctcattaagttatggctagttgtttcctgtctttgacaagtaaacttatttcagttctgttgtaaccatggataaggatgaatttggcttcccagagatgtttgtatttagatattctttaaacaaatggtctttgcttggttccttactaatgattcattcaacgatgatgcatctatcccaagattgggtgggaggattacataactgaataaaaaaaattatgctcttagttcactgcatgtattatgcacccattctcttcttgtaggttcagctgataactatagtctaaatgttgaagttgctgtcacttgtctaaagaatgccatctcctacttcagtgatcatgctgattacttgaagaatgttgctgctatgatttttccattactccttgttctaccacaggtagtggttaacatcatatttaatatttgtttttcggatagaaaattaatatattttgatcttgtacttatttaatagcttttagattttcccgtctctgggtaattatcaaataaccacttattttgccatgcgcagacacagagcttgaatttaaaggctttgggacttgtcaacaaaataaactggccactttatcagaatattgttgtatcttcttttggagaaggggtaaatatctactttggaattagtttgctataaatttaacgtacacttacaatatgaagaaatttaattatgttgctcaacaaggcaaatttgtcaaactcaagatcctataaagaattttccaaggtgaactgaagatatgaatcaagcattaggtcctgtctcctttggaaaaccaaaactttgaaatttgaaatgcacattttttacagatattatatagggaataacccaattgcaccatgaatagtacatgaacatgatatgttactacttactagtagtacttgtagtgtgggttttctaaaaagatatttttggtttcatcatatttctaagttgttaatcagtaatcacaacaattcatgaatatgtttatgtcagatgaaattgtcaatcatcttttactttagtgactcttgaagtaaaatcgcagacattgatacctggaagtttatcttcaattaacttgaagactattgataacatggctaagaatttcatggtccatcccaaagagcatatagcttggtttgttgaaagctgcagtgatttggagttgtcaaagacactcttcttttttgttcttttgcagtctcttttgataaaaccaaaaggtttgttttccccttctctttttgaattccattttaatatttttcagaaatagttaataatcttatatcgtataatgactaaaaacaagtaatgtttgaacaaataagctagaaataaatgtttgaagcatatcttatacatcccctagttgtacttttgtcttctctattagatttcttagccaaaaaatttcaagaggggactaaggaatgataaatattgactttttccttttgatcaaagatgaagacatttgtgcactatttgaatgtgtatttcctattctaaaggctgagtgggaaacgtcagtgacagctggtgatgtctcattggatgaggtacaaaggatttactagcatatttgtgcttttatttcattatttgtttactttttttgtaatgagaagctaatgttttacttctgttttgattgttgggaattcgggttgttttgcagttcaagtctgaagtgttagactgggattgcagtgcattctttaatgatcttttgtatgtcaagctgagccatcttaatgtgaagcttatgatttgcatattttggaggctagcacaactaatatcagtactaacttctgacattctgcttgtaagtaattcctttactatttgtaatcctgttatctattgtcttatgaacttgctttccttcttggaatttgttgttgttagactctcaccgtcaacattggttggatattaacctttttcaaaatgcagcatgacgatgataagtgggtcagcaagataagggatctgtttgtattttttgcttcatctaaattgaagcaagcattccatgaacacctccattacttagcagcacagtgcagaatatcacctccccgcctcttatctaagtttttcacagaggaaggtgctatacacttattccttttgtttgatttttcccatattttacttggccaatgttgtgttccttctactgtgaaattactgcctgtgttatggtgtagaaaatgagaaagaaaattttctgaatgtacttgattgtattttctacccagtagagtgaactgtttatattcaacaatattgcaaagataatcaatgccgaaacaatttaacaagagaacaatttagatgccactacttcctaagatgcattgatcctgactataccaagtatctaggatacttggaaaaataatcattaaaggagctctattctcctaaaatgttcgtatttccaagggagagaatagaactattttttctgtaattatcatgatctctcatgcataataatgaatacacgcagacacacatatttgctgtttagaaggtacaaaatttatatttgtagttattctctttctatttccattctttctccttttcctattctttttactccattttcaattattttgtatatccctgataaatccttccatcccccgttaggggcattttcatcctgaccaatccatgtttatgtgttaaagtggctgttttgtgttaggctttctgtatcctacgtgtttgacttgtattcagtcagaagtaagctgccagttgttagttagagacagttatgggttcactctattgtaacagattcagaggtgatacacttttgaatatagtttgatttcagatctagaacaatctttttctctcaaatctctcttgccaactttctctttggttcttaaaatctaacttggtatcaaacgctgtattttggtgttcatcaatggtttccccttcaaattcatttaaaagctaagatattatcctaaatctgaaagcacctccaccaaaaactcctttgatccttgcatctgctcctttgatactttcttggacatgatttctgttcacttggatgagaagaacttattccatcacattttctctccaaagcagatcaagatatcggtcgagtcattgaggtttatctcacgtcaaaagagcttgtgtatatctatgtatgtctgactccagtctgaagcaataatattttttgcattactgcatataagcccaactccagtttgtttcgtccatctatgcaaatgcaattaagttatagtttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgattgaaatcatggttgtttgaattgatatttttaacattttatgaatcagaagtcagataaaattcaattggcatatttgatatttttttggttgaatctttcattctgcaggtgttcctgctgcagtccaggttgaaagtcttcaatgctatgcatttctttgtagcctgtcacaagataaatggcaaattgaacttttagctgaatttccttctgttcttgttccattggcgagtgataatcaggtatgattctttgttagcgttactctctgaccttgtgtgtatttttttctcattttctgcaaactgccaatttataattgtttgcaaatggttatcctctgttacttttttggcttttttctttctgagaaaatgtgctcaaatgatttctttgcattgttttgaattttcttccagactataagggttgctgccatgaactgtatcgattcattgcgtacattgtggtgtcatgttgagcgttctggaaagaaaaatggtactctattgtcagaataatttgatgtagccctcaatgcctaattaattttaccttggaactttataagtttctaaattggtatgaacaggtaacaatgcaatgtggatccattttgtgggtgatgttttggcgttgatggatcagcaaaaaatattcatattgtctgacaagaaatttcttccttcattgtttgcgtctgctatgagctcatcctgtccaaacatcttggagcctcgaaatatcttggtacctcaacatatagaaaaaaggtatttatgatgttactatgacaattatcatttcattgtcaccaatattattaccttagaactatttgttatattcattgccttagctgctgctcatcaaatatgaccatgctctcttgttctgttgttggaattagctagatcttcttaaatgtggagagcagcattccccttttctttttaaaatctaaatgatataatgtttgacaactgacagtaaatttccctttgtcccgggaaatgatggttctgttgctgttcattgtccccattgtaacaactcaaagttcataaggattggagggatgcatgacacaaagaaagtcatatagggaaggggaaagtaaatttaagggtgggaggagaaagaaatggaaatttaggtagatggcatagagggttctctaggaggttcattcaatgttaaatgtgactatatatatatacacatatatattataaacagctgagaattaaaatggtactgaaccaatgcataaactgtaggatggaaccttaacttgacagttgaatgatcctatttttattcaaaacctgtttattcaaaatcctaacttagtacaaatgctaatcaattatattgcttataaattttgtaattatgggttttcacttgagagctgtttttatctattgtgttgttctacttctttattatggttgttctagaatgattgcttatcttcttcttgtccttatttatttcctctagatgaattcttcgataaacttgaaacaagaaattatgataaattccaaactaagcaatatgacactctagtttggagtattttattaaattgcatccttaggctttagtgtgcatgtgtatgtgtctctattatatgaccaattgacattaagtgtcaaattttatataacatcaaaccctattccttccttctcctttaatctaaaaaaggccaggattgattcactgaaccaatcacttgattaactgttttctcttcccgctacatgggccccgcctttgtatttttattgcttttgattcttttttccttgctgagtgctgacgagattgtgataagagttcttggctagtgtttccttttgggctatgaagatatagccatgaatggagtcattgcaaaaatactaattgtaaatatagtctcttcctaagaaagttcaagcaggcaaagttgctttatgtaccatacataaagacaagtctctagtagagactctctacaatcaaagaagccagcgaccattaattaaatgaaaatatgacattataaactagaatctcataagcgtcccgaagcgatccttttgggtcaccgtgaaagcattaaatgataatgaaaggtaggatttggtggtaatataaaatttgacacatgtacagtcacatatagactaacattgttttattttctttacatataagctttagtgtttttgtttgtttaatattacatgttgtgcggcttacctttttagtggactttaagctgctgttttgtgttattgagattgattgttgggatagaataggtttagaatattctgttgttattggttctgatacttatgctcattgcttgatgcatatatctgtgagtcttatcttgtaactttctccatcttacttttaccttttcattttgcttgttagtttctgtttttatttttttcaagaatgttccttatcttcattcattaaaaatgttcatttgtactaatttctaagattctttattccactttgttcccaaacatatcttttcaggtttgaccagcctacaaaaataaaaattcttggcttcattttgggttccactcttaaattctctaactatgggaaggtttgatgtcttaacgctcttctatgtttctattatatttttagttgtggagatatacagatcaaggtttcatatgttcagttccagattaacagtgttaagtgagggttttttgtgctatgccaagactttaaggaagtaacttatttgttgatgttggatgcagctaatgattttatccttattcaaaggaattgggaatgcccttatgcacgttccagaagttgggccgttgttgtcttcttttctggagcagtactataatgagctcaataagtcttgtccaaagttgtcaaacactgaaactcagataatgtgccttttgctggaggtatgtgtattgtatattttagttttagcttatgggatctttattatgaggtttggtgtgaacttgttcctcttcatgcgtagagctgtgttatgtcatctccctctggtggaaatgatcttcaacatcttttactgaaagctttgcgggtaagatattaagatgtgtgttttacttatgttatgtcttgttattttgaatttactgacttacattcttgggatctttcagttgggcggcatgacatcagatgaccctgcctgtgtaaagccttgtatcactgtcttgaacaaacttaacaatcaattctatatgaagttgaagaatgaagtgaaggtcttattggcagtatatctatttattttcagagtttgttgttgtcattcatgataattgatgagtatagctaatgatctagttaatgagtttatgataatctgtttcatagtgtaaataaaataattatcaccaatgtagcttttactgtgacctaaactaatagttttttcttatgcctgtcaggagcatctattttgtgagctcgtgattttgtggcataatgataatggtgatgtacaacgtgcaactaaagaggcattaatgtgcatagatgtgagttccttgctcttgatcaaatatcatgtgttctgtgtgcgatttctttagtggttacttgcaaagaacttaatcttttggtattattcaatctggacctttggggttttcatccctttaagaagggtgtttattttattttatttctgtttccgggggggtggggttgtggatcttggatccttttcccctttactgtggttaatgagctccgttgttttagctttgtgctctctgattctggacaaatcatggcctctctctttctatggcagtatttccatctattcccaatcagaccgtgatggtttctggctgttgaacttggcagccttgtgttctatcctccgttatctgtgtcactgttctgttctgttccttgctttttatttgatagcagatttcactgtgaaacaggtgtttcatcattatctgctgggtgtttagcttcaaattcatcaattgacaaaatggatgatatgtcattattcatcaattgattgtaaatttttttaaatgataagataaatgttttcttttaaaaatccttaaacagttaatatggtagtgacctgaggataaattttaacaatgtaaattccattgttatctgaccgaagcctttttggatcaactggttgttttgcactatcaatgttatttgttgtttgttttgcactatgctcttcaatgtccgatctcaccttgtggggtaagaatttgttgttgtttcttttcattgtagtgggaggtttttttccgactttttattccacggaaggaaaaaaaagaaatgaaattaagaataattggtggatatattggaattgcagattagtttctcaactgttggccacatgcttgatcttatacttgcacagaagagttgtataagtagttcagcagaagaaaagatggtgaagaaacaaaaattcataggacatcaagaagcaggatatcctcctaatgacatattcagaagagttaatgcagtctacatccttagttcccttcttgatgttttgctactgaagaaggacataacaaacaggtgacttggttacttctgaatctgaacattacattatgggtactgctgagatgagtagttaaaacatttaattgtgctaaattctcagtttgattgttgcaggcatttacttttagggcccttatttaagcttcttagcaaggtattttcagaagaatgggtgaatggtgccttttccccgaagataaagttaagccaaccttcaagtccttcggaagccaacaattacacaatatatcatattcaacagactctgttgataatcctggaggatataattatttctcttaaaagcatggatccgttaaatgtatgccttgtgaagctggaaaatttattatgttgttagaaatattattttgactaccttttcactattttagctatttccttatattattaagttttgccattgttgacaggaaaaaatgacaaatgaaattaacattaagctattgatagagtgcgcccggaattccacagttgcagtcacccgcaaccatgtattttctgttctctctgctgttaccagagtctttccaggagaagttttggagcatatgcttgatattctagaagttattggacaagctgctgtcacacaggtttgttaatacagggtttccctgtactgaacttagggcattcttttggtagagtagcttattagatccttttcttccctggggaacaatgttatttgtgtagaatagcttattacatccttttcttatgtttccatgcttgttggaaagttccacaagtcctacctcgattactagggcgtggtttttatacttgtcggacaacctcacttaatgccaattagttttaagatgaaatctaacatggtatcaaagcctccagccatttctgtcatttccgagtttcctttgtgcatcacttggtcagcaggcatctgtggaaggggagggggtgtggaaactggaaaatcctacatcacctacctcaattgttggatgaccttacttattaactgttgcaacttaacttttagttgcagtatttaatagaaattcttcacaattcaatttattagggactaataatccagtgtaggaactgtggtgtcatcatttctcttttttgcgtgcctgtagattgacagtcattcgaagcatgtttttgaggatcttatatctgcaattgttccgtgttggctggctaagacagatgatgtggagaaattactgaaggtttgtttttcacagaaatgatcttctgctgcttgatacaaaagaatctcttagcagttcaacctactaatatgtttttttttcctccagattttcatgaatatattgcctgaaattgttgagcacagaaggctgtcatttgtgttatatctattaaggtattcttgttctacttctacagttctacatcatgatcctgctattgatactttagccattggtttttggcctgtgtcttataatgatggctgttttgcagaactttgggtgagggtaaaagcttagcctcattgcttatcctacttttccgttcattaatttcaaggaaagctgcctgtttccttaatgttgagatgcaagatgttttaacattttataatgaggagtgggaatataaatttgcagtgcaaatttgtgaacaatatacaagtacgatttggcttccttctttagtcatactgcttgaacagaggggaaatagtgatgttgaccaggcaatgtttctggaattgtttattgtaatgcaattttctctgcaaaagttgcaagatccagaatttgtgtttaagttgaaatcaggtgaagatacctcagtcattcaggtataaatccatatcagatgcatgctagatacttgtatgctttttaatgtctttattcagttctataaggcaaagtctagatgtaacttatattatgatttttatggatagcttctatttttgcctgacccatgcccaataatgactagcagatacatacagtatgtttttgagatgttgatatctcttaactcataaatttggggatactatgttgacacccactggctgcaatgtggcgtcaccacccttgctgcttgtgtgcaggctaagggacatggtggaaagctttgataccaattgataagaactttgggagagcaacaccacaaaagctagccgttgtacttagttagagagcccgaggccttataaacctcgctagaattgcatacttctaatgtacaacttgattcccatagcctgcaattggatcctatcattaacatatatcttccctgatttattaattgaaggaggtatgtgtggggtaaaaaaaaatattgaatgtaagtttaaggggtgtcaatgtaatttgcctgacaaaatagtatgatacacatgatgaagttaaatttctatcaatcagaaattgtgattttaaggtgagggacagatcttacgatgatattgaagcagaagcagatttcattattatgaactgaaatattcattctttgtagaagaatttatatcatatttgttttccttttctttgtaggtttcatgctgagatgctgtttttggtttttgtgagtgcaatggcattgatgttgcatgcttcttatatttgtgttaatgttgtgatctttgaataagcctataaacacttgttttttttagatgaacatatttatcagaaattggacttagggccctaattcaacccgactaaactggcttgcaaggtgaggactgcccaagcttgataagttctatttaaccacatgtctagttgatgtgggactaaattaccacccttgaggttgcaattaaggcaacccttaaagaggccacaactaaggctaggtgtgactggaattttgacaactatccaacaatattcattatcaaaacctgaactgaaatattctttgtagaatatgtcatattttgttttttctttgtaggtttaatgttgagatgctgttttggtttcttattgtgatagcaatggcattagtgttgcatgcttatattttttttttgttttgcaaatgttctaatctttgaataagcctatattctcttgtttatttagattaacctattcataataaaaataaatgtgatcgcttcttgaatatttcagagggcattgggtgcgcttatggagcatgttgttttactcatgcaacttgtagatgcaaggaaaaagcaactgaatttccctgtaattctgaggacagagttgaaagaaactatgcgtgcacttgcaaggaatctaacaacagttatgatacctgtcatatactttaagatcataattaaattgcttcgccatgcagacaagaatgttggaaaaaaggtatggtttttaatgaagttacaaaatatgagattttattaggatcttgtattattttgatacaagggtaaaatggtaaactacaatttggtggtgtatttatctgcttcatagtattctattaaacatcctgattttcaagatgtttacttaatttggtgggtatacacagtggtcatttattcttttttcttatgatgattgggttttattcacatgttatgaatacagttggttctatatataccgtaaattgtttagttggtattgcccacacatcttggtaaattatttatttgccttttaatatgtgagcatgagcgcacaataagaagccaaaaatactaagggggtgattacttgcacttttgtttcctgtattcattttctgttttcactttttaattacaaaaataccaccttgttttcaatctgtttcctgttttcatttatttgtataggaagcgctaaaaacttttttccccctccatttcctgatttgacaatcggaaacaaattgaaaacaaggtgacatttttgtgactaaagaaaacagacaatagaagtgcaagtaaacactccacaagtttttaatagaaaagaaagtattgatatatcgaaaaacataagagtcttccaatgtttgcacaccatgagcacggtatagaaatccacatcttttttgtggtgtgaaagcaagacagtgagaactgtgatttgatatttgtatttcttgtgctgcaggctcttgggctgttatgtgaggctgcaagaaatcataaaaatgtcagtttaaagcttaaagacaataaaggttcaaggtcaactccaagttttcttttgcttcatatgagtgaaacttctcaagaatcacttaataaattgtgtttagaaattattcgagtacttgatgattcatcaaatacctccttgaaagtggcagcagtttcagcattagaagttctagctgaaagatttccttcgaataattccatctttagtctgtgccttggatctgttacaagacatattgcatctcataacttggctgtgacttctagctgcctcagaacaactgctgccctgatcaatgttctaggtccaaaatcactggcagaacttcccaagattatggacaatgtgatgaagtcatctcgtcgagtattggctagtttggatatgaaacccgaaaccaccgatgttttatcagcctcaaatgaatcccatttttatgttctcatcactttggaggcagttgtggacaagcttggtggatttttaaatccgtatcttacaaatataatggagcttctggtgctttatcctgaatgtgtttcaggaatggatgtaaaggtggagtctagagctcatggagtacgaaagcttcttgctgaaaaaattcctgtaagacttgttataatgtagcattgtgtaattgtggtatgaaatgaaatacccatttttttctttaccaatcactttatttttttacaggttcgacttgccctgccacctttgttaaaattatacccagctgccattgaggctggggataaaagcttaacaattgtatttgatatgttgggaaccataattggtacaatggacagatcatctattgtggcattccatggaaagatatttgaccattgtttggttgctcttgatctgcgccgtcaaagtcctccttcagttcaaaacattgatgtagtggaaaaaggtgtgcttaacacaatgactgttctaaccttaaaacttactgagagcatgttcaagcctcttctgataaagagtattgagtgggcagaatctgaagtggatgaaactgcatccagcggaagcattgatagggccatatcattctatggcatggtaaataagcttacagagagccatcggtacgtcagtatttagttagctagttattgttcgctttagaaaatgttctttgaaataagcatgctttgaatttagtcaaacaacactttatttgggtttctaaatattttgggtatattttgtattctctgaagaagagtttagctttttgtttgtattaaattatgtacatgtgatgtagatacgaaaattgggttttgaaccactgtaaatatgtcaaccacttgtgacagttgagacttgtacaatttggtcgcagtatttaaatcagtagttagttttcaatgtgatttccttaattattttttatgtttatgccaataaacataagaatataatcacttgttatgatgttaccttgtttacccaaaataatgatcaaatcacagcagtttaagatggtcctatatccttatttgtaggtcattgtttgttccctacttcaaacacttgcttggtagttgtgttcatcatcttagcgatggtggagatgtggaagtgtctagagtgaatcggaagaaaaaggccaggattctagatgatggcaatataaaagaaataggcagtgtgtctatcaagggctggcatctaagggctctagtcttgtcatccttacataagtgtttcttgtacgacactgggaccttgaagtttcttgactcctcaaatttccaggcaagtgaattgtttacataataagaactcattttttcatctattcgtatccgataccaaaacttttgaatacttcactgatacgcgtctgtgaagcatcaagcctttttaaagatatgaaaatctaatatagtttacatattgagacatagaagcatgtataaaaattgaagcattgtccattgatgcaccaaaatggaaactatcctctttatggatgatctcaaaaaagtaatgagattgatactattttgttggtagattaataggacttgatttacgatgatttatactttttaaataatgtgcaggaagtatgcttttaatttgaatttgcagaattttttttacatgtctagatttatatcttatacctatcctatcctatacatttttagaataattgcagtcatgtcagatacttttcatatctgatatatgtatcgcatgggcatcaatatctatttttaccatttgaaatggttatgaaaaaattctttagaagactttttttccacctagagtggaattttttaaaggttatgcattaattgggaatttttcctttccatttaaaaatactttgcattttttctcattccattgaggaataaagtattcctaagtctttcagcttccttcagtaatatagttgcttgctatattctctcactgactgttatgtcatgcttgctgcagatgttgttgagacccattgtttcacaacttcttgtagatccaccagctctgttggatgacagcataaatatactaagtgtgaaggaagttgatgacctactggttgtgtgcatcggtcaaatggcagtgactgctggatctgaccttttgtggaaacctttgaatcatgaggtgaactttatgatttcttttcatttttactactcgttaatgattgggcaagtaatttgatactgacatactggtaacttactggcttcactatcttgtttttcattgagggaaaatgcatatgatcattgtcctcgggaaacactgttatgaatatgactggttctactattctccctattagtttgggtgcatggatgccccaagacattttaacaatagattaagaatatgtctaacagtagaagtaattaactctctaaaggccataataaaagtgtaaatacagatatggccccccaaaacttttaatttaacgaatccactcctcttacatgtaaacattcagtcagtagctgtggtgcagcagcaagccaacaagctggacggggcaaatgggctcctagaaatgccagcaggttcaaacgtggagtttccaacattagtcattcaaactagaaaaacgagcaaatccttaccaaaacttcctttgctagacctccatttgtggccttgctaacaactacctatcaacatcacctaagcatagtaaaatcatgtcctatttgggaaaactctcaacaagaacttctaagagaataaaataagtaggtaaaatggattgagtttcttaagttgaaattaacgtgagttaaaacaagttttttgagaagctaaatcagaacttctataaaagtttattttaacttatgagagaagcttaattcattttacgctctttttttccttattctgtaagtgcttattgaatagtttatctgaacagggtttcagtcatgttagagttgaccttttctgctatgtttatcgggctttataaggtttaattgtaaatagactgtagcttttatgtcattttgatcaaactttagtaataatgtcaattgacgcctgcggttttgacctaccctaccggccaatgatctttaaagatctgaacttgctcctgtactcttgcatcccatttcatagtacgttagctttggtcctttgtagtcatcaatgcctcatttatgtgttgaagtttagtccattagtttgttgttaatagttttgggtattcagtaatatgtgttgctcttgaatgctatatgtttgttccccgcaaatactagtattccttagcaactgaatatctttctgccttctttatcccgttttttgcaggttttgatgcagacacggagtgaaaaattgcgagctaaaatattgggcctcagaattgttaaatattttgtggagaacttgaaagaagaatatctagtgttcatagctgaaacaatccccttccttggcgaactgcttgaggatgtggagctttcagttaaatctcttgctcaggaaattctgcaggaaatggagtctctgagtggggaaagccttcggcaatacctatgatgtaagattaggagggcagtatttatggttgtgacatgagcaaagagctagagatatgtaatcaaacaagaaatttaatcgataggccagtgtaaattgtggttaattaaggaaaattagcatttgtatattccgataatggttaaagttcaatttttctcgttcaacttttataacactcaatcatttatagcataatgcttttaagaggaatatttgtaataataaagagagaagaaaaagtataaaaataggattaaattgatttattttgaaatttgatattttttttaatatcatactacattcccagagaaatttaatccaagactcttgcagtctcttatattttgaaaagtattctatttttttttttttgtatctctttcatttataaaataatggttgataattttggtagctttattagggccgtattaagaatagtggaattaggaagtaagacaatggataagcaatgtacctgcttgcttgtggcattgatgactggtttaaaaattaggtacgtgttgttacattaattatttttttagagaacgttaattgttcttttacaaaaagaatctgaaactgataaattgatggaggctacggatcagcgcggcagatgcaactgtcacatcagtttttttataataatttttaattctatcataaaatcaagtattttaaggatgaaggttttcagtagtcttgaaaaatggttcgtgtatgatcaatgaaaggaattgtgggaaatatattacgtagaaagtggccaggtaaaagtttaaaaaattattcacgttttaacttttgattttcagactataaaaaatgtttatgaaatcaaaacatacactattataagttatatataattcttaaaaaggatggataagacataaaaatataaaaaatatcacaactatattgacatccttattttctaagattttataccaatacccaacggaaatttatatacaaaggaagaaaaaaaacaaaatatgggaggattagaccaaggtccatagccaaatcaacaaaactcatagcagctcattaaaattacgggcataacggtgagagcaaaaagggggaactgaatcccagcaaaaataattacgactgagaactgcaaaattagccaactgatctgcagagtggtctccttatctatagacacgtgtagctttaaaactaatatgactggatctataaacacaattgttccatttagtggaaaacttccaaggaacaagattcaggttatattatttataattttatataaaatgtaattttatcgatctaattattaaattataattatatgacatattttttgtttttttaaaagcaatttatacattgttagaacacttagtaacaacacaaggtgtgcctaactaaggccaacataacatattgattagttagttgtttcaattttttttaatcaaattaaagttggacaattatataatttgttaagtaactctgaaatttagttaccttttagtatgacataatagcttatttaattttgtaacattttgcttaatgtcaaacatagcacagagttactcattacgtttgacagcggagtttatggatggagaatcaaataatggcagtgcactttcatgttacactaagtgcacgctacattaggtgacttatcaaacaataatatgatgaaaatgctataaaattatttattaagtttattttctacattatatatgaattttgtttgttttaaatgtgattttcaaaaactaattgtatataacatttatattatatatgtgattatttcatcctcaataaaatttcaaaaacaaatattagtttaaaaaaaatataaaaatatctatggtcataattgaaagtaaacattaatatttttttaagatgaagtttctgcaaccatcattttatttatttataataaattagctatcatactgactataagaatctacttgctgattatatattagattaatatttgtattgttcccgctgcactactcataccataggggtaaaactttatacaccagcaaaaagacttatacatccagaatttttttaaaatgccaaaaatgctctcgcgctatacaagcacggattcacgaatccgtaagattcttacgaattcatgaattcgtaaaattcttacggattcactaatccgtaagattttttttttttagtcatacagattgggcaatccgtatggtccatacggattggcccaatccgtaagtaattttttttaagtaagtaagttttttttttttaagttaaaaaatatttttccaaataatgacacatgtaggttttaaacctgtgaccttcaggttatcaacacaacacttcaaccaactaagctaataggtcaattatgctaaaagttaattaatgttgatacatataacattaaattgttaatgtatatttaatacacgtataagtttacataataaattttgtaacaattaattttgatataataattaaagtattttttacatataaaaatcatagatttaaataaaaatcataagtttaataaaaatttacaggtttaataaactataaatacaaatataatttttaatttaacctgtaaatacaaatataatttttattagtcctgcaaatttttattaaaattatgatttttatttaaaactatgatttttatatgtaaacaatactttaattattatatcaaaattaattgttacaaaatttattatgtaaacttatatgtgtattaaatatacattaaaaaatttagtgttacatgtataacaataattgatttttagcataattggcctattagctcagttggttggagcgtcacgttggtcacaggttcgagacctacatgtgccattattttaaattatttgaaaaaatatattttaacttaaaaaaaaaaaacttacttacggattgggtaatccgtatggcccatacggattgtccaatccgtataactcaaaaaaaattacggattcgcgaatccataataatcttacggattcacgaatccgtatgtatgaagcgtaataaaagtgagggtatttttgaaaatgcactattctgaaatggtgtataagtctttttgctggtgtataaagttttacccataccataggcatcatcaaatcctttttaaaataccaagtgggtcaaagttgggcttgtcttccttccaggctgaacccatgctaagctatgaatattaatgaagcttcgtttgataccctgttagaaatcgtgtggagtcttttcaaatgatatatcaataattgctttttgagaatgcatgtggagtacatgtgccattatagaaactgcagaatttactttactttgttacgggtcacggggtgaattgaattctgcacttgatcagcaacacccatcttccacgcatccaacagttttaaatctttttacatcatctttcttaataatacttttaatcactaaattaaaatattaattttgtacaataaaatattaaatacatttaatttttatttaacattattaacaaaacttattataaaaaaataacattaataattaaaatttagaatataaaatacaaagtatagtcaaaacacctaaagaccgtgctccaccctctttatccacccctctctctcaactactttataattttataaagatcgtgctccaccctctttacccaccccctctctctctcaactactttataattttataaagaccgtgctccaccctctttacccaccccctctctctcaactactttataattttataaagaccgtgctccaccctctttacccaccccctctctctctcaattactttataattttataggaataggaatttttatagaataggaattgagtaaaaaattgtgcctacatgaatgatcgtcttgttagtgtagtccagttatagcacaataacaagtgaaacactaaaaaccaatgtgctttaaatcattataccaataggaattaagattgattctatttgtatagcctttatctaactaaaacaagtccatttctgaattgtcagcataccaagaattttgatacgccatagcattattcaaaattccattctcatcatagaattacattagaactttgatccttaaatacctgtgcagaaaagtggtagtataacatacaatggccatgagcaaaacgagttctgcattcaaagggcttttgcatacactagccaaactgataatcacatagcagaactgacagtgagacaaacttttgattttgctaacagatgccaaggttcaagtgatgtaggtatgtatataatatattagtttcgttatgcgccatttttagttatttttattttccatttcagaattcagttacttaatttcctggtctaatgtcatgaacagaaattgtgaaaaatcttgaacgcttggagaagtagaaaaacatactgccaagtccagaaattgatgcattcatgaaggttgtttcatcttataaataatatctgaaaaatcatgcatatatgcaagttaagggaagtactctaatttgtgttttttttaaactgattttactcaacagaacacttgttggtggcaaaaaccacaatgttaagacagattatgttttgaaagtgccttggtcttgatgtatgttcagatacggttgtgggcaatgatatgctaagaggggtctctgttgcccaaaaaatgagagttacaacaggtgatctctctcccctttctaggaatttgttacaattttctttgaaatttggctcttgtagtgatatatgcttaagttaatctaactggattacctcttgtatcatacaaagaaagagggtccaaattcagtccctctattttttttcttgtttttttttttaagatgaagttaattatttccacttgtaatgtgaaatatagctttgataagatttaaggagatttcgtttagaattttgtttttgactcctaagattggaaattgatatataataatagagaagctaacacagtccatacatttgaatccatatttgttctaggaacaataatttatagatgatacaaaattcaatccatatttgttttgacagtgtctataccagaagattaagacattatgaaggcactaattgaagttaaaaattgtagcaagcaatgacatacttttgcctttcatattttttctccaagagaaatgattgttggaccacgaaaagctctatttatggatgctactgttctgatagctctaccacatcccaagtagtgaaatgcataggaaattttgttcatcaaatggatgctactgttctgatggctctacttcaacctgcaccataaacatttgagctctttgatgatcttctgcttctgtcagaggggtacgttgcatatcaaggccccataggagacgtgctggagttttttgaatcattaggcttcaaacttccatcctgcaagggagttgcagattttcttcaagaggtatttgtagatttttgctcctctaatggttaaactcaaatgctttatgaaattattgcttaaaaacatgttattttcctgtgtcaggtgacctctaaaaaagatcaagctcaatactgggctgattcttcaaagccatataaatttatttcagtgccggagattgcataagcctttaaaaattccagatttggaaagtcggtagaatccatgtgtactgctccttttgataaattaaagagtcatccttcagctttgcccagaactagatttgctgtgccaaaatgggagctctttaaggcatatttctcgccagagaccttgatcaacaggcataagtttctctatatttttaggacctgccaggtatgtatatatactcaagtaaataaggatgcacttgtttctatatatagttttcaattcttaagttttttacaagtagaattcatgataagttagcctaatgtttgtgatttcttggtaccacttacagaatatttgtcagtaacatttgttggaattgtcacatgcacaatgtttgtgcaaacaaaatttcatggtaaggatgaggaatatggcaatctctatcaatctgcactatttttcggactcatacacatgatgtttaatggccattctgaattgtcactcatgatagcgtgtcttttacaaacaaagaggcaatttattttatcctggataggcatggtctttggccacttgtattcttggtgtaccttattcccttgttgaagctcttatatggtctcgtgttgtatactactctgttagttttgcccctgctcctagaaagtatttttctttatttgtaaaccaacagaatagtatacaacacaagaccatataacagcttcaacaagggaataagttacaccaagaatccaagtggccaaagaccatgcccatccaggataaaataaattgcctctttgtttgtaaaagacacgctatcatgagtgacaattcagaatggccattaaacatcatgtgtatgagtccgaaaaatagtgcagattgatagagattgccatattcctcatccttaccatgaaattttgtttgcacaaacattgtgctttgtgcatgtgacaattccaacaaatgttaacctttggcagcaagaaaaaatgtcgaatttagaatcatgacaacatacccacaaacaataattgataaattcaaaaagcacaagcctatatactgacaaatgttttgtaagtgataccaagaaatcacaaacattaggcgttctattgatatatcgtgtgtattttgaaactctaaacttatgatcatcttgtctatatgttttcgatgttgaattgattggcaggaaaatttgttggaaccttggaggtaatctatatatttaaatatgagctctacttttaagttgcaaaatattgaaggtcccctttctaacttatcatgaattctacttgtaaaaaaatttaagaattgaaaactatatatagaaacaagtgcatccttatttacttgagtatatatacatacaactctctcgcgagaaacacggtttaaagatctcccattttggcgcagcaaatctagttctgggcaaccctgaagtatgactctttgatttattaaagggagcagtacacatggattatacagactttccaaatctggaatttttaaaggcttctgcaatctccgcacactgaaataaatttatatggctttgaagaatcagcccattattgagcttgatctttttagaagtcacctgaaacaggaaaataacatgtttttaagcaataatttcataaagcatttgagtttaaccattagaggagcaaaaatctacaaatacctctttaagaaaatctgcaaatcccttgcggagtgtaagtttgaagcctaatgattcaaaaaatcaaagagctcaaatgtttctggtgcatgttgaagtagagctcaaatgttagcttctctattattatatattaatttccaatcggagtcaaaaacaaaattctaaatgaaatctccttaaatcttatgaaagctatatttcacattacaagtggaaataattaacttcatcttaaaaaaatagaagaaaaaaatagagggactgaatttgcactctttctttgtatgatacactaaaaggtaatccagttagattaacttaagcatatataactacaagagccaaatttcaaagaaaattgtaacaaattcctagaaaggggagagagatcacctgttgtaactctcatttttttggccaccagagacccccttagcatatcattgcctacaacaaccgtatctgaacatacatcaagaccacttcaaaacataatctgtcttgacattgtggtttttgccaccaacaagtgttgcctgttgagtaaaatcagtttaaaaaaaacacaaattagaggccttccctgaacttgcatatatgcatgatttttcagatattatttataagatgagacaaccttcatgaatgcatcaatttctggacttggcagtatgtttttctccttctccgagcgttcaagaatttttacaatttctgttcatgacattagaccaggaaattaagtaactgaattctgaaatggaaaataaaaataactaaaaatggcacataaggaaactaatatattatatacatacctacatcccttgaaccttggcatctgttaacaaaatcaaaagtttgtctcactgtctatgtgattatcagtttggctagtgtatgcaaaagccctttaaatacaaaactcgttttgctcatggccattgtatgttatactaccacttttctgcacaggtatttaaggatcaaagttctaatgtaattctatgatgagaatggaattttgaataatgctatggcgtatcaaaattcttggtatcctgacaattcagaaatggacttgttttagttagataaaggctatacaaatagaatcaatcttaattcctattggtataatgatttaaagcacattggtttcagtgtttcacttgttattgtgctataactggactacactaagaagacgatcattcatgtaggcacaattttttactcaattcctattctataaaaattaaaaatgttgactaaataagattgctctacataatagcttaatatttgtttcaaagaaccgaaaggtacccataatattagtaattacaaattgtaaagtaatactcatattaacccacgcggatgatggttatagagtttaatttccatgaactccaaaatttacattgtcaatcaattatgaattataaagtagttatagtaaatatcaactaacttactttatatgacagtttgtaacttaacaacagtgtaaaaatcctgtacataataagtgtatacactatttattagtcataattaaattaatgttaaccattagttctttaggaccgtacacaaaatgcattgcatggaactaatcagttacaaacttaaaaaattagtgacagaaatgttccaaacttacagcaactcctggagaagttttgaagccaagaacacatccaacagtaagaccaacaacatagtaagaagccaagtttacataagccactactgcttgccatccacttccaattgccacccctgaaattttccaagaaaagttaacaaaagtgtgataaaccaaagttggtgcttatgctagtgtactttttatagctttattacctgataatataggttgaatgccatttaagaaaacagaaatagaaagcaagggagtcaaattagacacagcaccaatgacgtcagagtcaggagtgaaaaatttgctcaaagaaacccggaatatcaagataattgtgcagaaaaccacactaatgaggatgctggttccattcactacgaagacagaaaattttgctactcttggatgtgatgctactaattcgttgctgacttggacactgcaatcacggaaaataccattagcatgcttttgagaaagttgtttgaatgaaaaacacattgttttgttgcaaacctggctactgtactaaggcctaacataaattgcatgtcccagttcaaaaaaaattgcttctaactctttattttacaaattaaagttcaaattttttagaatgtttgcgttttttatttatcattgttgttatctactgtaataatattgatattttaaatgataagataaatgctttcttttaaaaatccttaaaaagttaatatggtagtaacctgagaataaattttaaaaatgtaaattccattgttatcactgaccgtagccttttggatcaactggctgttttgcactatcaatgttatttgttgtttgttttgcattatgatcttcagtgtccaatctcaccttgtggggaaagaatttgttgttgtttcttttcaatgtagtgggaggttttttccaactttttattccacggaaggaaaaaatagaaatgaaattgagaataattggtggatatattggaattgcagattagtttctcaactgttggccacatgcttgatcttatacttgcacagaagagttgtataagtagttcagctgaagaaaagatggtgaagaaacaaaaattcataggacatcaagaagcaggatatcctcctaatgacatactagaagagataatccagtctacatccttagttcccttcttgatgttttgctcctgaagaaggacttaacaaacagcaaaagaatcaaaataatattttttaataaatatttattaatttgggattgtttgaaaactattaacgcaaatgagactgtcaaacacgtccaaattaggtgtgactaattttgatgctaattcggtctctatttcagtcgctagcactttttacgacaaaatattatgattttttatatttacgatcacaatattctgttacaaaaatgttagcgactgaaataaaaatcgaaattagtgtacgaatttaaaatcaattttttgatttacaatattatttttttcaattttttaaattagtgttgcgatcacaatattatattttttaatttttttaactgaaatcgttaaaaaatttaaagtataattttttttaagcatacgtctttaaaatcattttttttacaattttttattatgttgttagaaatattattttgactaccttttcactattttagctatttccttgtattattaagttttgccattgttgacaggaaaaaatgataaatggaattaacattaagctattgatagagggtggattagagattaattcttctagcagtgtgtaattattattgatttaagaaaattttatttacaataaaaatctaacatgaattattcatttaagtaaattatttctcgcgtatgaatacaatagaatcttagtcattatgttaatcctataattctattatttttcttttaaaattacaaaaaggttaaaattttattaaaaaaaatgaagaggcaacaagagccagaagatgtggacttcgtagaacaaatgtacatcagatagccttcatcattcatcaaccatacatgttttgagtggccacatagcaagtctcagacactcttaactttctacttggaatcctctcataccgttccaatgcacatgcatatttccaatgccaatggatagagacatctgggtagtccgtggcaggttgattcaatatgagatctcttttctgcctcatgaatagttagcacatgcttattctttgtttgttgttagctagttagagaattgagagtgagggcgagctagtaggagtattagaagggagatgctgattacaggaattatatttcttctaatcaacacaaaatatgtacaatccttttccttgcttatggagttattttgcacccaaggaaatgggatgggacctacgcggttttgcttaatttccttgctgcttcacttcgctctcatgctgaaataaaaatacataaagctcatggaattgggaaccattggatggatccacctcttcttaattttctttttctctcccactcaactgccccgacctctaaagtcatgccgcccgtacgaaaatttattatttatattgtcccatcaaataaataatcattatactttttaatgcccacgttattttaactaaataatatttcatgtttacgctataatatttgaaagatgaagattataaaaattgtagaatatattaaaaacgaataccaaagacaaaagtcattaatgattgacattgaatattaaagttatcgacgagtaagatttaaaaatttgtaataagagttaaaacttataaacacccacacatccttttgtctcatcgtgacacttgtggatcaatgaattattacaatactctaaaacattttaatttcagcactttatcttattcatagagtaattttatcgctttcttttacatttgttatacttccctttaaatcttcatcttttttcaatctcaatttcttctccaaactttttactcctttaatcttctgtatcttttttttgcgcactttattttcgtcaatactcttttattttaaagttgttctatgatcaatttgcactttactctttattacatacttttagtttgttctcatgttaaaaatttaacattaacctatggtacagtacctattgaggaagataaaagactttcagagaaaatgttcatcctttttctcaaatatctatgggattgtgtcgactaaaacaagcacaaaattgcatggtcaaaatactataaactatttcaaatctttttaaacttgcagcaatcgttttactattaactaactaaaatcagaatgcgttaatcattttttaagggtatttgtgacactgcacaatcttgaatatcttcccggcgggatacacccgaaaatcaaaagttatcatgcaaggatatgtttggtgtgtcttacgaaattcgattatatacatcatgaataactatgtcggttgattctcaacaaagacatcattcagcatcttaactgggtaattgtcttcaatctgtttaatgctaaagcttctttaatctaactcatacaattatttgtatatgcatgacatttgggaaatcaaagaaaatatgacttaaacgagagtgtgtgtcacaatttcaagatgacaggcctctggccatggccctcaggacttatatattcacctttctagaaattgctaatgttctcagtgctgattgtaaacattacgactactagtatcaatttgtgagctaatgactgctcatagaaccatctgtaatatgttgaattgatcagttctgccttctagttgacacttgagcgaggacttgatcaatttaagccattttaaattttactggccacttccacgattttgtcaataaattcatattcgtacctacaaaagtacaaggccttttagttcattcatacacaattttcattttctttctaataattatcaaagtaaatccgcacaaaagtaattaccacacaacaacaaaaacagaattgcaaactctaaacaaagcctaaacaccgtaccccaatgtctctcacaacgttattccttgttaacaaagtcaaatttaaatgaacggatttcaaattaaacggttcatagattttcatgaacgatgcacatattaagtgattattatcatcaactatactagtataatagacattaatcatgaaaataagcaaaaagtaaaagaataatatttgctgtacccggttttcaagtaaaatcctttcaagttggcgacatcaaacaaagctgacctccatttcttcaccctctcagagtccttacccaacatattttcatgctcggtcatggcttcaccatagctatttctttgatgccttaaatccgacggtaacactttgtaaaagatggggcaaaccagctggtttttggtctccatacactcaaggatggtcaaaagcacatcaagacagtacgaggaacgtgcatagttttcagaaaatacaatgatcgaaagccttgattcttcaagaactccattcgtagattgtgaaatttggtccccatcattcatgaaggtttggtacctacttcggcacaatgcattgttcagaaaacctgtaaaggagcgggtatcgtttccactaaaactcagaaatatgctatagcggggtacaatgaagatggcatctcgcacaatgtcttcgattaattcatattcatatcggcgcctacaaaaacgtacaagaccttttaattcattcatgcacagtttacgtttttctttatctattcttcattactttaagacgggttcaagcaagaaactctctcactcacttgcacattttttacaattaattaaaaattataaaattatgaatgaaaactattaagtaaaaagtgagatctataaattttataattttaataaagagtgcttaaaagttttttttttaatataataaaattgagtttcaataatcaatctccccaaagatttcaaggcaataccttaaaactcttaaggcaaaacaaattaaaattaacttgataaattagctaaaagcttggattgtttcttactaataataaattctagtgtgataattcataaaacaaattccttatcaaacagtataattattattggtttctattttgtttttcttttaagaatgaaaggagaattaactagttacgttagattgtcactttaagaatattggccaaagccttgcaattctaaatataaactggctcaagcccatgttaaagagtcatttgacaacttagaagttagaatattcaataaggtataaatcaaggaaaaaagcttcgtgcaaatatcacaagtggttttggtctttgaggattaaaatgctagtttgcatgacttaagcaataaaaatcggcatgagttacttaacttagtatatgaaattttaatttcaacaatgatacataaacaccatcctaggctaaagattcatttgatcgaaacattttaattttaacttaaatatctttttaattcttataatttaatatttatttttttgtttttataaaattattttttgttttaatccttacaaacaatgtttatttttattttggttcttataggactttttttttactatctagagtactatagtatttaaagtaatttaaaaactaaaagtaaaatatatataatttataaagactaaaaataaaataaaaaaaaaaacactaaactattaaaaacatatttacacctttatttttcattatctctcttattaatgtcacgttgttctgtgtttcttttttctttcaaagtgtaagccagtattgaatgcctacaaaaaattgttattttcattttcttttttttcaaattaagaagcggtactagctaaattaagaagaaaaaaataacggcacacctggaggttccgtctccgaaacaccatccggacaagctggcgacttcatacaaagctgacctccacttgagtactatctcgtttcctaagcgacgttcaaggttaaccaggtcctgtccgaaactaccagtctgattccttacatgggagggattcacgtggtaaaacattggaataactagttggttctttcttgcccttaactcaaggatcatgacaagttctttaaggcaccacgaggaactcgcaaagtttttggagagaacaacgattgaaatcctggatgctttcaatgcttcaagaatagcttcaaagatttgatcaccacccttcaacccaacatcgaagaatgtcctcaatctcgccttccgcaaagcagcatagagattacctgtgaaggtgtggcgcgtgtcttcccctctaaaacacagaaatacatcgtagcgccacttcgcaattcccccttcatccgccatcgcattgaaactattaagcagataacataagatattatatgatgtgctgacactatgatttacgcgcttttgcttaatttccttgctgcttcctggaaataaaatatatggatggagtccttgttttcttctccattttctattcgaaaattatatatgtccccctcaaatttgtgcatttcatcaccacttgaagaaaatatattatttccttaatctcattataattgtcacgagaaaaaattaaatctcaaaataattattttttgttattttaacgtaatattaattatcttttttttatttatatctcttatgatgttaaaatagacaataaatttataaataaattaatgatgatataaaattaattttataaaattatcattctttttcaactttttattttcatttttatttatatataacaacctaaaaatacaattataacagaatgcaggaattatattgtatgtataaatatagttgattttactttatgagtgactaataattatttactattagatatagttaattgcatgcaaaaatataatttactttacatcacaactattaattaactttgtatcacaagcagttaataatacgatcaaatcattaaaatatataataataagtaaccatatgaaataaaataattagtttcaacctaaattctaattaattacaaactttcacaatattttcgccaaatagagagagaaaaaaagataattatgtaaatgtggatccaattactttgaatatatagaaattattgatttggaatagagacccaaaaataaaattatatattctattcaaaataaaaataaagtgcgagtcatagctcgaaatgaacctccaataacataaatccacaaggattttttttcacgtactagacaaatttctttatacacccaccaaaagcaacaaaaaataaaaaatgtccttccataagatttatacggattgacaaatccgtaaggttcatacggattgataaatccgtaagaatcttatgaattgcaaattcgtaaaaaccttacggattatggattgcctcatcgaccttgttgacattgtcgatggcgagattgagttggggattgtggtcgaggatagagaaggggatgtcgagggagtgggccttctcttccgtgctgttagaggtgggaaccccgacgatgtcggtgagttggccggaggcgaggagggcaccgagcttggcgacgacgaaggatatggattggccaatacgtatgaatcttacagaagagtatttttggtttttcattttattgttgggtgtatgggaaaactagctggtgtaggaagaaaaatctaatccagaattgggacaaaatgtaggacccaaccaaataatggtttgtgtgatgatatttgtgatacgaaggtgaataatgaagagattaaatattctagaaatacctaaactagaaaaaaaaattatgtatcacattgttcatagcttcctttttatacaaagataaggaagagagatatggtatacaaccttattcttgtatatacaaagaaactttttccatattcaaactcatgaccaacaatgtactaaagcataactatactaagattaaaaaaattaattaaggattaaaaactaaaatttaattttttaaaacgacttaaattaaaaaaataacaaatttatattgactaaaattgaaaaatgataattttttaggaactaaaatttgaatttcaaaaatttctaaaaagacatagaaaatataataccatgtgacaaaacatattagtatcacccacatgggtgtcacatgattacatcatgtgtgttgctgacatgcaattttgttggacatataagtatttgacagtttttatttaatgtgggagactaaacttactttaaaaaatagagactaaaattggataaagaaaattgacagacttaaaaatggaattctgaaatagttgaatgatgaaaacttatctaactttaccatagattgtgtatactctgtttttatttttgtgagcagaaggcgatgtgtttaaattttgtttcacggtgccttacctaatgccaatatgacaaaacaaaatattaccacttgttttttttttttatctaatcaacacaaaacattgaaacaagatgtagaaaaacacaacagacctcgagaattgaacaagatttagaaggaatacaataaaccttaggaattgaactggatgtaaaaacaacattgataggcacaactgaattcaagggcagttatggatgttacaatcagttagtcacacagctccacagcatatacttgactgactttcgctgtcattggataaaaggaaaggatttgctatatgcttgctacctcaagtttaatgaccttttgtacaatcctttcgataaattcatgttggtacctacaaaaatgcaagatcttttaagacattcatccgctgtgttcactttctttctccttatcagactttatgtcatcaaaacaacaatattaagctcgactaattaatcttctcactaacagattgccgtacaaaatacaaaaaatgctccaaacaaaacaacacacaataccccatgtctcggacaagaactgtgccatgtttagcatttcatagatggtcaatatcacttaagagcgaagcatatattaagtaattaattaaaagcattacgtactcattttctttgacatggtctccttccaaattgctgattttagacaaagcagacctccatttctgcaccttcttagagtcctttccaaatcttttttcatgagcagtcaaggcttcaccataactttttgtttgattgcaatccgacttttgcacattgtaaaatattggccaaaccatttgattgttggtctccatacaatcaatgatcttggcaagttcatcaagacaccacgtggaatatgcatagttttcagagagcacaacaattgaaatccttgaactttcaattgctctcataagcttctgtgaaatttggttcccactctccaattcctcatcgtccatgaagattttgaatccctctcggcgaaaggcattatagagaaaacctgtgaaagtgtagcgcgtatcctctccggtaaaactcagaaaaacatcatatccgggcaaggcttgcacggctgattccacgatcctttcgatgaattcatattcatactggtacctcctataaaagcacaagtctttttaattcaccaggggtattcgagcatgcacaaccatattgtttctattaatcagaattataaaagttgacttaagcttgactaatctataaaacagattgcgactgctacactgaaactggaaacagaaccttcaatttacagcacacatgtatttctctcggttaaacaaaacaaagtgactttctaaaacgataatgagaagagaagacacactgtttagcagattacagataaaataagtaatagttgtagagattattatggaacttaatcaattaaaagtaagcatacccagtttggtaacaccatccactcaagttggtgacttcagataaagctgctctccattgcttcaccctctcattggaatctctaaatattgcttcaaatttatacattgcttttccatagggacctctctggcgccttacgtccgacggatccactccgtaaaagatgggccacaccagttggtttatcgtcctgttacactcaaggatggccacaagttcatcaagacatctcgaggaggatgcatagttttccgagaaaacaaccaccgaaatccttgattccttaattgctttaagagtagagggtggaatttggctgtcgtgagtctgtaggttacgatcatatgcaagttcagtgaaaaaggtcttgattctcttgctgcgcaaagcattatagagagtaccagtgaaggtgtaacgggaatcttcgccatgaaaattgagaaaaacatcgtagtttttgagttcattcgacatgatggatgagaagcagtagcagaatgtggcttgcttgtctcgttgactcctcctaatggccaatgcctcccgacttctctttctctttttcataaatttaaaatattgaacacgatgactatgacatcggaatatttaacacgatgccctacgcggttttgcttaatttccttgctgccccacttcgctgtcaagctgaaataaaatacatgaacatgggttgactggaccagatggatggatggagtttttgttttcttctccattttctaatcaacaaaccagtcatgtcattactatcatctccatttttaaataaaatacacaatttgtaatttttttatcaatgacaagatttgtaattaattatttaatctaaacccttaatttaatttaatttaatagttgtaatatttaaattcttatttataacagttgtaataaacagcaatccaaaagtttttttttcaaaccaaaaatgctcccgttgatagttcttgtttctcataaattatttaaattctgtccatatccttttactgttgtctgaattccaaaacgcagtctaagcaacgggagaacactcaagtttcttccacgcctatacaattcaacggaataagtacgactgtacgagaccataaactcggcccatttccacaaaacatttgatctgacatttctatagacttcattggggaacagggggcaaagacaccattttggtgctagtttttttcctgtaaacgattcagattttgaagtacaactattatgaatatctcctaataatatttaatatcgtgtttggtacacacaaggatgtcctttagtcccattttttttagttaaaataaataaaagcagtaaattgattctatgtatacgtttctcgaaagaaatgacagaaaaaaattgggagatcaaaattttttgttaacagaactcctaaaatgtttcaggaattgctctcttttcaccagtttttgctgtcacaaaatgtccagctgaattacgcatatcctatgagtgcatggaatttaacaatttcaaagccagagcttcttgctcctccaacgtaaccgcaccggtagttatacctgcattccctgaaaattcatttctttcaccctcgtcactgtcactatcaaagtatattttactctttttatgccgtctatcaacagtctcatctacttctgacccagatatatcatcttggtcgtcctcttccgcattctcagccttccatttcaacttctgcttgattcttttttctctaagccgctgacgctctataagcttgtcttccttgtcagccttcttcaaatcatctcgcatccttctatagtattcagctttttgttctgcatcaagacataaagatgatgtggcaaaatgtacaaatagcccatgcttatgaagtaagaaatgacacgtatacacatgtacaagcaacaatttcaccttcagcttcagtttgcagttgaaaagtatggacatacctggatcgagcagcatttctttgccactttgtgtgtcagctatcctggctagtggaggaagtgtgtggccgtcatcatcaaatacaaccctagtcccaagtggcctgtgtacattaatcttgagtttctttttcttcaatacacgagttgctggtctgcataggaaagaaccaaattggtaagaacaataatggaggaagaaattcaaagctccagatgaatggctcccgccaagaaatatgaaagatccaactttatacccaacactaagtttgaattttttttctattagccacatcataaggtgttatattcaaatatcaatttgtctcagcaattttgaaaccagaagactagtgtagcccctttccataatcatatataaaaaaactaatgcagcattatcagaaagcagcctaattttttaatctgtactactgtaaaaatgtatatgggaacgtacattatttcttcaatttcagatgacttaacttcgccttcatttgcagtatccgctaactgaagaatatcattttcggtttcctcatccttgaaagcaactgtgtctagcttcttcctcgaaacctcaaagatagtttccttgtctgaatcctctggctcaactaaaattgatttagttgtcacatctttagatttaattttctggtttagaaaacggattttgggggtcattggtaaacctaatgacgctgaatactcgtcaataggtagtttcataacatcaaatatgtctttatccttttggatatggatggatctcaaatatgtgatgaatgccctctgagcccgttgctgcatgtctgggtatttggccagtaaagatgccaacaaactagaaactggttgcagtagttcttgccttggctgaataatcaacaattgcaaaaacatggaaagcaaatgtcagacaaacataagactgaagtgaagcagatttaaaagtgacaccttgatgttcaaatgaaaattggaattgcatgcatactattaatttgcagggaaaatgtaccttattaaaatgcactggaacctttgctgcttttaacttttccagcatttgaatttctgaaggcaacagaaataaaactgactttccatcagatttatatcgagcagtacgaccaactctatgtatgtaagaagctacattttcaggacaatccacctacaaatgcaagagagaagtgagagactgaacataaaaacaaactttttgcttccaacaccccccccacaaagccgtaaaacttgctccaagacaggaaaccaaaagcaggatgagactcacctgaacaacccagtcaactgccttattaaaatcaaggcctcttgcggccacatcagttgagaagagaacagagcgcttctcacaaaactcagaatatattgccattcttctttcctgtttcatcctcccgtgaaggcacttcaatggtatgccagggtgcagtttcttaaatgcttcaaagacaaattttacctattaagcagggatgtaaacattatggaagatagtcaagctcaaaagagggaatttgcaccaaaaaccacatcttaaacattttccctgtttacatgaaagaattatggaaaaattcatcctaaaaatcctttaaaaattttctcattacaataaccataaccagcacaactgaaaaccataacagaagttctacgcatgtgaactacatcatgtagttacaaataaaacaattatttacttggccattgaaatgaaactaatgagacaactctcaagtttcaatcataaaatcaaactacattccctccaattgcacaaaatatcttgaaaatgatgactagccagtagccatgcattggctaagcatcaaagggtgcaacttttcaagtggcatgacagtaaaattgtaatagaaacctataatatacaattcccttcaacaagaaaaagaatttcttgaaacaggacagaaaagtggagttggagttacctgcttacagcttgaaagaaagacaagtgttttcgactgtagatgtgtctttatgaaactccacaacatatctaacttattttccaggggaacaatcatcacaatttgcttcaacagagtaggagtggaagtcacagattcttcgtgcacactcagatactctggatccttcaaacttagtcttgcaagatcttgaattgactttgtttgagttgcagagaaaagcaaggtttgtctacgctttggtagttgggaaatgatagcatttagttccttcttgaacccactgtctagaatccgatcagcctcatctagtaccaaaacctatatccaggaagtccacccaaccatcagctatattgatcaaatctaatgatacatatctgttttctggtttgacccaaataaacacgtactttggaagacaaaataaaaaatttatgctttacaagggcctaaagcatataaaaattaaatggcacctatactctgcttcaaccactgttgctaaatcacctaggcgtggaagcaaaattttctgaaggttgttaaggctagaaaatcttgacatacccaagtacaattaaaaacagacacgaggaaacagatagtgatataaaacaaacaacttaattgtaactctaatttcagagtaagattgaggttaatatatcacatataagaaaaaaagttatattaacctgcatctgtgaacaatcaaaattgggagtttcatccatgtgttgcagcagtctaccgggcgtgcaaatcaatatgttgagctcatttacacgttctttctccatgtcaacgtcctttcgaccaccaatgagaaggccagcactaaaattatggtgtttgccaacaaccttcaacacatcaaataactgaccagccaattctcttgtaggcgatatgatgatgctgccaacaccatcttcaggtccccatctctctctatacaacttttccaacacctatcattcaaaattcaccataaacaaataacaataagcacaaatactacaattcaatataccatctattcacccactacatattaaatcaatgaccttgcccaaacacgtatcagcttctcatggctttgaactttcgatgttgattttccacacttattagtaaaatgttatgattatattattatcataatatttgcattcagaaaccacgataaacaaataataacaagcataaacatcacaattcaatatatcgtattctatttactatatattttctcactttgagctaatcttgtgattatattattatcataatatttgtattagttaaataaaaagaaatacaggggaccctaatccgaagagaatggagctgagaaatgaagcacttacagggataatgaaagcgagggttttaccggagccagttttggcggcgccgaggatgtcgcggccacagagcgcgtggggaagagacgctctctggatgtcggtcatggccacgaacttggactctcttagggcgtccttggttttcttcgagagtggaaattgatcaaagcgtgacgcgccggcgtagcgcgagtaggtgttatcttcgaggcggccaacgggggagtttttggggagacgcggcagcgacattgggttcgaaccggagtccggtggctgaaactggatccatgaattcaagaggtttatctcttcctcctctgaaactcgctgttgcttgcgaaactccttcgatttcggccttctcattgctgtagcttgaaaacgaaggtgaaggtgaagatgaaaagcaacgttggggttaggtttatggtttgtgggttgcgtgttgttgcggcagaaagagtttgcagtgcaggaattgttggcggttaaagcttcatttttgtgaacgacgatgagctacgtaatgggccgagtgatgaatgattgggctggtccgattaatccattgccattatttttgtacacttttttttattttcctccatactattgtgactagggatatgattcgccttatgtttcatacatgtctagaacttgtgaggttgatgttattaacacaattctcccattaaactaataaattaattattttaaaaataattaatattaatatataacattaaattttttaatatatatttaatatatatataattttacataataaatttataataattaattttaatttaataattaaactataaattaattgtgctacttatataattttgataataattattagtggatgaaataaaagacaacaagaagaatcagacaactatctaacaaaggtagctgaagcggacaaaactctcatacttgacaaagagatgaagaagaaatttcatgtttagccaaaccaatcagcatattgatgggcttctctaaaagtaatttgaattgtactgaattagaaaatatttaaaatggatccaatgataaaataacaaaatcataatattagatcacataaactttatctctaaaatggatttaattcggatacaaattacaaccccgacaacagcgtttaccaaatttaggattaatttcggagtttgttttatttcttttccagtacaaagctattcattaaaaaaataaatgaggtaaaaaacaacaacattgtcgatcatgagtcttgaataaactagaaagtgatatataaagtagaggttaactaaatttttaattcttaaattttttttaaaattttagtttttaactatgaataaaagtttgactaaaaattttaataaaaaaaattaaaggattatgatcaatcaaatttttatttagagattaaaattttaaaattaaatatttaattaatcctatagagacaaatgagagaggagaggtgaggtaaggcatggttcaattcaagtgttgtacatggacagactcaaaagtacctaaccataataatgacgtggaacattcctaaaatctccaaaagcacctaacctataaagtgttacaaaagtcaaagtagcatatgcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacatggacaatccgatcaacttaacctattcctttcatccagtttaataatacatcctctcttctttgcccttatatttgctttctttttataagaggcctaagggtgtggttaagaggtttattagattggagagaaactatctatgggtaggtttggaggggaattagaaaattgcttggacagaatgagaatatgtttggcttccaaaacagaaagatggcttagggattaagaatatctccatatttaatgaggccttactagcaaaatgaaagtggaggatgcttaatagggggaagggttgtggtatgaagtcattaaaacaaaatatgaaggatggaaaaatttaggatcaagtagagctcttactaaacaatccacttgctggaatgacttggggagggtatgtggacataatgaggaaacaagatggtttgattcacaggtggtaccttgtgttggagatggccggccatgtggtaaatttttggaagaattattggttaggagatgaaaaactgatgttaaaatttaatagaatgtaccccaattctttgcaaaaagacaacgtggtaggggtatgggtaagtggaaggagagacatgggtgtgggatttcaagtggaaaaaaaggtggtttgaatgagagggtgaggaggtggaaatttttcaggatcttactagtgcggttacattgaacattagcatcacgatgacttgtggagatggaagctggattcttcgggcctgtgcatactctatgctacaacactcaccaaatctgactaatgacaacttttacaagcatctttggcagatcaaggccccgccaccggtgctgcatttcgatggtgagagggaaattgggaggtatggcttggacgatggtgtcgtctaccatcatctggtgtgtgtggagattggaaatgatatgatatttaatcatgcatggtgtgttatctttccatggtctcttggacgatattagtatgaagtcatggatatggcttgcatcataaagtggatgatggatttaattactcgtttgctgaatggatgatctcaccaggcggacctacatacatttgaaggtgggcagattcacccctcatttcaataaatcactagtatttatcttaaaatattatattttacactccataattttatattttgcaccctctaattttatgtatttgaacctctttaccagtttaaatataagagtaagtaaatacaccatcttattttaataaaatgcaaaaaatatcatattttgcaccccataattttatattttgaaccccttaattttatttatttgaacctccttacccattcacacgtaagagtaaataaatgcaccctcttattttaataaaatgtaaatatttattttaaaatttcatattttattcttcttatcttcgtgtttgaatccaactatcccatatcataataataattatcaatttttattttttaaataaattgtcctcactgatctaggatctagatccgccactatcaccaggtgagtgcattttgaatcttgatagctttaggcacaattagctgggtggttagattttagtgttggatcttactgagggagggtatcgtacgtgcatgggctatggttgtagaagtattggggagtagcaggtagtgtgaaataggaatatatgtattgatcttgtgatactcttcgagtatgttccgttattatctatgtatgttgttttttcgagtttgatgtgggtacaccttgtgctctattccagtctttctattaatggattatctttgcctagcaaaaaaaatgaataatattggtctcaactctcaactctcaactcatgcaaagtgtattcaaatgtgaaaaaacacacattgcataagatgtcttggcataaatggatattaatgagtagattaacatccgatccaagtgaggttataaatgaccaattttttatgagtagggttaggtaagacattagagagatttttttttatgtaaacactctggttgcatgagttttacatatataagttgcatgagtgatacatatataagaacgtagttttgattgaaaatgatacataagttattataaatcttttatacatattttttaattttcgtaaataaaaaagataaataaaatacttgcaatataagtttagctagcatactttatgtatgttattctttttttaaaatgtccatagtattattctttgctattattaattaaccaatttaaattaggcataacaagatttgaacattactcaaacccttcactaattattttactccaatcaatttttatttttacttactttgttcaataacttttttactagtactgaatttcaattatttaattctaatattgaaacttcattataagtactcatgattgaagtcatgaacttgagtgctaagaataaaaaaacattagaattagcgtttcttgaactggtctattaaggtctaaaaagtattgtaattaaaaatttaagtaaatagaattttatataatttaaaatatagtatatatttcttcaattaactttattttgatatattgtttataatataagcaaaatatctactgagtatcattattaatattgagtttgttattaaaattaacaacacaataataactactataatataatcaattttgcatatttatatgacaggtaacaaactctcaattttttaaaccaactatgtttatttaagcaaatagcttattttcacactaatgatataataaatgctagatagtgtgaaaattaaatttttattcatttttatatgataatttaaaagctttttgttacaaaattacaataaatgactacaaacaactatactaacatgtttgttaaaaaaaatatgttagttaaaattttaaaaaagataacaatgaaattaccctatcataagtatacatcttttaaatttgtagttcttggtctttagattggtgtatatataaaaagtatttctctgagttcaaattaatataaaagttccccgcaaatcagaaaaaaataaaaataaaaaactaaaagttacctatttatatttatattgattacttctaggtctgattctttggattttaaaataatttataacaattaaaattaatgaaatgcattgaatctgcattggaagatttccttttgtttgattaatgctaaatgagtatacttaaaaggaatattgccttctagaaagggaccaaaacaaaccatcatacaatagtgcggaatgaacaaaatacggtaaaacaaacaattcaaacaaaccgtcatataataaggacgaacaaacaatcacactttatgtacatctatggctacttattaaataactaatgaacccacaatggagaaagagaagaaagaatggcgtccgaaagggagtcgtttgcaagggcttccaatgccgaatggatggaagaagatgaggaggagcttgaaatggctgcattgctgaggttgcagatgcataagcgtgccaacacgtcgccgtctttggatatgagcaacagaggtggctcagggaagaagaaggccaaggttttggagcagattgatgtgaggaagctgagccgcttccaccgtgaacgcctagtcaaggatgctttggcaaccaatgaacaagacaattacaagctcctctctgccatcaaggaatgctaagagagttaaatatttttccatcgtttatctatatctatctgccattgtcattaccattagatcatatttaaatgattaaaattaaaataataaaaaaatcttttcttcgtggagaaatgagatccagtatcgaagtgagatattacatgcatgaaagggtttatatatgattttacatttaaattatttgtgtggttgactgcaaaagggttgcattggatgtaccaagtatagaagtgagatacagaaacttgacaattggagccaactttgattaattacacgtgagatgtctttgaggttcatacctattactcactctcatactaacttactaattaatcaaattaatttttagtaaaaagattgattatgggttatgtgtaataacattagttcaataatattgtccgtactctagctcaataattcgttatgtgttctgttagataattaatatagaagcagaagtgcttagccctggatctcccgccattgctttatatgcttttggcatttttcgataaacttttttagaagtatttttaaaagaaaaaaagatgagatgatttttttataaacaaaaataagttctccattagctcattttaaaagctcactaatataatttttctaaaatatgagatgttatttacaaattatctaatgaaaaactcattttagcttataaaaaaactcatttaatttttgtcttcttactttctttttctagaagtacttctagaaaattttatacccaaacaaatcatttatccatgattgttacttattatttacaaacttaattgcaaattgattcataatggtgatggtggcatccagggtatgataactggcatgggaataggtcgacctcaaagacattccttgaccatcttgaataatatcagcggtgtgtcaaacctggaaggcataatattcttctgttattttacattatttattgagtaaactatcaatttgatccttgaaatactactctctccttaatggttgataaagtaagaaaagctaagtaatctcttaaatattgaaagacttttcaaattaagccttaaactttattgaaatgcatcaacttaagaactaattaaactgatgaatatcctatacgtcaaggattgcttgaacaattttattactttagggacaattgaggagaggataatagtttgggaacaaaattggtgatttattaaattccattcataattgatatttacgatatgaaatgcaaaagtatgtcattgcttgctacaatttttaacttcaattagtgtctttgttcaaagctatatttcacattacaagtggaaataattaacttcatcttaataaaacagaagaaaaaaaatagagggactgaatttggaccctctttctttgtatgatacactaaagaggtaatccagttagattaacttaagcacactgcacatatcactacaagagccaaatttcaaagaaaattgtaacaaattccaagaaaggggagagagatcacctgttgtaactctccaatcttaggagtcaaaaacaaaattctaaatgaaatctccttaaatcctatcaaagctatatttcacattaaaagtggaaataattaacttcatcttaaaaaaacagaaggaaaaaaatagagagactgaatttggaccctctttctttgtatgatacactaaagaggtaatccagttagattaacttgagcacatatcagtacaagagccaaatttcaaagaaaattgtaacaaattcctataaaggggagagagatcacctgtttaactctccttttttggccaccagagaccccccttagcatatctttgcctacaaccatatctgaacatacatcaagaccaagcactttcaaaacataatctgtctcgacattgtggtttttgccaccaacaagtgttgcctgttgagtaaaatcagtttaaaaaaaaacataaattagaggacttccctgaacttgcatatatgcatgatttttcagatattatttataagatgagacaaccttcatgaatgcatcaatttctggacttggcagtatgtttttctccttctccaagcgttcaatatttttcacaatattagaccaggaaattaagtaactgaattctgaaatggaaaataaaaataactaaaaatggcgcataacgaaactaatatattatatacatacctacatcacttgaaccttggcatctgttagcaaaatcaaaagtttgtctcactgtcagttctgacatgtgattatcagtttggctagtgtatgcagaagccctttgaatacagaactcctattggaatttttaaaggttatgcatcaattggcaatttttccattccatttaaaaatactttgcatgttttctcattccattgaggaataaaatattcctaaatctttcagcttccttcagtaatatagttgcttgctatattccctcactgactgttatatcatgcttgctgcagatgttgttgagacctattgtttcacaacttgttgtagatccaccagctctgttggatgacagcatgaatatactaagtgtgaaggaagttgatgacctactggttgtgtgcatcggtcaaatggcagtgactggtggatctgaccttttgtggaaacctttgaatcatgaggtgaattttatgatttctattcttttctactactcgttaatgattgggcaagtaatttgatactgacatactggtaacttactggcttcactatcttgtttttcattgagggaaaatgcatatgatcgttgtcctcgggaaacactgttatgaatatgactggttctactattctccctattagtttgggtgcatggatgccccaagacattttaacaatagattaagaatatgtctaacaatagaagtaattaactctctaaaggccataataaaagtgtaaattatatggccccccaaaacttttaatttaacgaatccactcctcttacatgtaaacattcagccagtagctgtggtgcagcagcaagccaacaaggtggacggggcaaatgggctcctagcaatgccagctggttcaaatgtggagtttccaacattagtcattcaaactagaaaaacgagcaaatccttaccaaaacttcctttgctagacctccatttttggcattgctaacaactacttatgaacatcacctaagcatagtaaaatcatgtcctatttgggaaaactctcaacaagaacttctaagagaataaaataagtaggtaaaatggattgagtttcttaagttaaaattaagtgtgcacaagttaaaacaagtttttcgagaagctaaatcagaacttctataaaagttgattttaacttatgagagaagcttaattcattttacgctcttttttttccttattctgtaagtgcttattgaatagtttatctgaacagggtttcagtcatgttagagttgaccttttctgctatgtttatcgggctttataaggtttaattgtaaatagactgtagcttttatgtcattttgatcaaactttagtaataatgtcaattgacgctttgtatccctgcggttttgacctaccctaccggccaatgatctttaaagatctgaacttgcttctgtactcttgcatccccatttcataatacgttagctttggtcctttgtagtcatccatgcctcatttatgtgttgaagtgtttagcccattagtttgttgttatagttttgggtattcagtaatatgtatagctcttgaatgctatatgtttgttccccgcaaatactagtattccttagcaactgaatatatctctgccttctttatccggttttttgcaggttttgatgcagacacggagtgaaaaattgctagctaaaatattgggcctcagaattgttaaatatgttgtggagaactagaaagaagaatatctagtgttcatagctgaaacaatccccttccttggcgaactgcttgaggatgtggagctttcagttaaatctcttgctcaggaaactctaatattgaaacttcattatactagtactgaatttcaatgaaacttcattatactagtactgaatttcaattatttaattctaatattgaaacttcattataagtactcatgattgaagtcatgaacttgagtgttaagaataaaaaaacagagtctgtcctcttagatgtgttcgtccaacttaattaggattaaacaagtaacaaactctcaattttttaaaccaactatgtttatttaagcaaatagcttattttcacactaatgatatgataaatgctagatagtgtgaaaattaaacttttatttgtttttatatgataatttaaaagctttttgttacaaaattacagtaaatgactacaaacaacgatactaataacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaaattgattcagttataatttattatcataattgaaaaaaattaagaagtgaatgtcaaatcatttgcattgagtatcttaactgtgataatattgagtatcttaattgtgataataaggctgttcatgccagacaaagtcttgatgctttcatgcaacccacaaattataaagacacatgcatgtttaatttccatcatttgaaataaaaatcaattttaatgtggaactaatagataattttataaaaataattatttattaaatatttatttgttaaaagttgaatatttaaatgattaaagtattataaaaatagtctccctgtgataattttattacaagttttttataaaaaaaagtattttttatcaatattacaacataaagagaaattaagatatcaatcacaagatacaattgaaagttgtttgtaattgaaaaaatgtttgcaacaaagttttatcgtgttatacatttaattgtattttatgataattaatgttagaaatttaaaagaacaaaaataaaggtgggaagtaatagatatgaaaatattgatatgaatgtatgacaaaaaataaaaacatgaataaatcatgatagtgtacaagagataggtgtaagattaaaaaaagtgtcaacaaattttctaagactagaatcggaaattaatgtttgggagaccaaaacgtggaggaaattttttcattaatctcatgttaaattcttttataagcgaataattttaaattcttatcagatctctttttagagacttgaggtattttcttaattgggattccaatgtttatttttatcaccaatttttacataacacacataacataaataaactcaaattactaaaaaaaaatatttgaccattgaaaaaaaaaatgtgatgacaacagtaaaagatgaaaaatgtcataaataataagtgaaaaaatgtgatgggaacatgagaagaaagataagagaaatatcattattaatattgaaaccgtgtttaaaaataacaacaataaatataattaattttatatatttaccccagttaaactgattattgtcaaatttgttcgttgacgatagcttgtgttttccattacaaatgttttgtacgagggatagggatggtattatcatggcttgagcgagtgcggtgtggcgattttgtctctctgccattacaacttaattatgcagcctccaactgcttctacatttcaccattcatctttctctcgaagccctcttcaccaaaatcaggtttcttccattttctctcaatattccttttggcttatctcattttactctctctcggagtttcttttttcatttcaaagcatttcctcagtttcagaacttttttacttcattcaaagcatttattgttacattatatcattgttttctattgctttccatgatgcacaaataaagttttcattttgatgtgtatgtttccaactttttcttttttgtagtaatagcgccgtgtgaaatgtgaagcttatgtttgtgggccagctttgtgtgaagtttttgacttttgggttgttgttggtgacgtagaaagggtgaattggattgaattagttgtttgtagtttgggggaaggacacagtaaattaaaatgagtggagtggggattgatattggaaatgagaactgtgtgattgctgcagtgaagcaacgtgtgattgatgttttgttgaatgatgaatccaaacgtgaaacccctggtgtggtgtgctttggagagaagcaacggtttatagggtcagctggtgctgtttctgctatgatgcaccctaagtccacaatatctcaagtgaagagactaataggcaggagatttgcggaccctgatgttcagaatgatttaaaattgctccccgttgaaacttcggaaggcccggatggtggcattctgattcgcttgaaatacttgaaggagactcgcacgttttccccggttcaaatagtagcaatgctctttgctcacttgaaggctatagctgaaaaggattttgagaccgcagtttctgactgcgttattggggttccatcatactttaccaacttacagagacaaacatatctcgacgcagcagcaattattgggttaaagcctttgaggttgatccatgattgcactgcaactggtcttagttatggagtttgcaaaacagattttcccaatgcagctcctatttatgttgcatttgttgacataggtcattgtgatactcaggtctctattgcagcatttcaggctggtcaaatgaagatactttcacatgcttttgacagtagcttaggagggagagactttgatgaggttctgtttagtcattttgcagcaagatttaaggaacagtacagcattgacgtgtattctaatgccagggcatgtaggaggctgcgtgtagcatgtgagaagttgaagaaggttttgagtgcaaatgcagtggctgatctgagcattgagtgtttgatggatgaaaaagatgttaagggctttatcaagagggaagaatttgagaatttggcatcaggattattggagaaatttaatattccctgctacaaagcattggctgatgccggcatgacagtagaaaagattaattctgttgagttagttggttcaggttcacggattccagctataactaatttattaacttctctatttaagagagaactgagccgcacgctgaatgcaagtgagtgtgtagcacgtggttgtgctctccagtgtgcaatgctcagtcctattttccatgtcaaagaatatgaggtttgaatattgaaaaaaacacattgattcttatcctatctatatgatatgtatatataggagagtagatttttgtgtttgtagattcttaggttagaaatgtaataattactaaatgaacaaagttgttacataggtgctaggtttattttctgcatttaatttgtctatcttaattgaaatatatctaacttcatagatatcattaatcatgtgtttttttttttatagaattttgcattagcatgtattactctctataaaattaatgtaatttcctgtgtttgttcagatccaggattctattcctttttccattggactttcatgtgatggaagtccaatttgtgaaggattggatggtgtactcttcccaaaaggccaacccattccaagtgttaaaattctaacatttcagtgcagtaatttgctccgtctggaagcattctatgctaatccagatgaattaccacctgggacatctccgaaaatcagttgcttcacagtatgcctgctttagaattttactatgatgtgaaggagtttagatcatcttgtccgtgattctttgttattaattttttattaattattaccctctctattcttgcttctttggggtgcttcatgaaaggcatgtggtatagtctctatgagcttattcatcttcttcattttactgttttggtatgtttaattctacaaaaaaaaatagtatatactatatagtaatcatcatcataattgcagcttttactcttgaattgtaagtctaggactcagttatgtataaagctattacttgttatacatgtgcttgtattttatcatagtttcaaccgtggattttttattcaatggttataaatgcactttattctttagaatgcattccctcactttagaggagtcaaatccaagacctgcaatgttgtttgaagttcaatgttgagtggtaaaaactcaacaaggaataaagctcaatattgccaactcaagaatgttatgatggataagtagacacacaaggtagaattaggaatgattccttagaaagttaggcaccatttgttgtagaaaatatggtagaatcgtgccttaagtggtttagacacatgtgaagacttgtagaagctctaaataaagagagtgaattagatggaagatagttcaataattagatgtagtaagagacgaagaaaaactataagttaaatcattaagaaagattaagatttaaatggtttgtttagacattatttatgataagacattatggtgtttttgatccatgtagccaaccccaccttctggtaaaaggctattgttgttgaatcttgggacaatgcaatagacacctccccctttcttgaaggagcgaaagacttccttattaaatggccttgctgaccatcgcttgttctgatctcaaaggaagtcattgctgtaaaagtgttaggtatagcaatatgagaatctgtaggtgtgcacatgcttgaacaaatcataatgttaggagaagcagatatggtggatctaacaccatccatatatctactgtctaagtttctcaaatggagagaaatgactgtatttaatatttagcatcttcaatgacaattggctaacatttgctaatgtctattctatattataagacatctcaatattacaggacaatgaagttataataattggttgtgagatactgccattccttgtgccagtgattaaaaagtgttatgtatgcttatgcctacaccttgtttttgtatgcttatgcatttgtttgtcatttctattcagattgatcctttccttggatcccatggaagtaaggcgagaattaaagttcgagttcaactaaatttgcatggcattatcagtattgaatcagctacagtaagaaacctcaattttatctcttcatatcgcattattagttttctgagagatctttctatgcacatggacatttttgtctttcagttgatcgaggatcatgtgaatgattcagttacaacaggtgattatcattcaaattttgaagcaatgaatgttgaacctgtttctgagacagttgaaaatgtcccagaagattgtatcaataaaaagtgtgaagctccacatcattcagtaagtactcccatgttgttctctctctctcccctgctcacctttttttactggaagatatctcagatattagagatttctagcaaattgtccttttaacacgaacaattatatggctaaattttaattatctgattatttctgatactgaatctgtaccatgtctttgactgtcagtctgtcgcaaccgttttttataatgtctgtgatgttgtatatgtacatttttatcttgtggagattgttttgattgcagatatgattcatgttggtgttttgagaaaataagtgttactatcatgccttgttacaggctgatggtacaaaaaaaggtaaagccaacagaaggcttcatgtacctgtgagtgaaaaaatttatggtagaatgaccaaggctgagatattggaagctcaagaaaaagaactccagttcgccgatcaggacagaataattgagctgaccaaagacaagaagaattcgttggagtcttatatttatgaaacgaggagtaaggtacatattcaatatcttaatgagatgtagacatgactggcttctctgattcaattacattgtataagcggtcacacatttcttctgctaaaatagataattgttcattgtatgatcctttttttcttctttttcatatctttactgtgaggtgttccttcttcaaaaactagagccttaaattttgccatgtaaatatgaaagtattgaatatatcaaaatgagaaaaagctgttgtatatagtcattgaagaattgatttttaatgacttctgtcatgactcaagtaaatgtaagggtaaaactttgtgaagctggggatggtctgctgttatactttgtaataacatctgcataggatataccgatatagaattaaaatctgaatccttatgccttttcttaccgttgattttattaaagctgtattcatgtgtatgctctacttttcattctgtactggtatttaaatttatttgcatgtatgaatagctattcagcacatatctaagcttttcaagcgaacatgagaggaaggacatatctaggagcctgaaagcgactgaggattggctttatgatgatggtgatgacgaaactgtagatgtttattctgcaaaactagaagaactaaaacaggttacttttgtttctccaatctccatgtttcatccgccatacttcttgcttataatctccatcttctgcagctggtagatccaattgagtttcggtataaagacacagaagcaagaccacaagctacaagagatttgttaagttgcattgtagagtatcgaatgtctgtagattctcttccaccccaagataaagaacaggtacgacaataaactagtgaataagtataattgtgggatgtttcccttagtatcagtttttaagtgacaactttctttttcagatcatcaatgagtgcaataaagcagagcagtggttaagagagacgaggcaacagcaagatctttaccctaagaactttgatccagtattattgtcaagtgatatcaagagcaagacagaagatttaaactcgtatgattttaactttctgttttccttttcagagatgcataattgtagggtactatgatcattcatttgggtcagaattatacccctttctgaagcaaagcattgttcatttgctccaatttaactccattgtcattatatacattgattttatctcaaaaactaatgaatgttctattttgatggattttcagagtatgccaacagatattgaaatccaagggttctccacttccaaaagaaaagggtgaagacaagcagaatacttctaatcatcaatgaagacgatgaatgaactgaaggcctaaatttttaatagcttctgacaaacgtgaacttttttttaacacttttccccgtccggggagttgaaagagataacttcaaatacagtgaaatcattggtaattaccggttcaatctgctttttatatatatatattatttttggccccacgttctactaaagccatccaataagttagtacgtagacaaccaatcaagtagtttattttttgtcaagggttgctagattttatgctcgtcaacaagttttcaatttaattccaaattgtattcaatctatcattttggatgaaataaaatcgtgaagattggacgcttctgcgaaactgaccacctttatggctttatctttattcgctattaacaaaagcaattttgttatcctttttattaaaaaattaaaaggttacaaggattttggaaaattaaattccttttctatttttctagtgaaaattcctaatttttgaatctgtacacgtatgctaatctcacgtatgtcctaatttaagtttccgctcacaaatattatgtcctaatttaagtttacatcgtctgtaaacttcagtatttatttggtacatgtgcattaaacatcaacaaatgaagccaataaacagcataagcaacaaaaatagcccaaacaattcaggcgaagcatctctatcctccgctcaagatagacggaataaaaggtcttcttgatgtcttcatttacttaaaatttgctatcatttctatcgttccattactttaatctacaaacaccagaagtaaattatgcataattgacatagcaacaagctatcataataacacagaaccaagtggtgaatcaagatggaatcgaagcattattgggaatcctaataaaaaaagtgaaacattatctaaagttacaatttcatgatggccaaagacattaggtccttgtgcactgtacagaactacttgcataagctcacaatatctacttgccaggattttttagaatcaaatcttcactaagcaacaagaccccaattcagtttcctcgtgcgatgctgcatgctggatggctggcttccttgtccgcatccaacacatgataccggaagtttagggcaatttaacagcattgaacctatagggtattgctagtcataagatccacaagtaaattatgggatgtggaccaggcggataataaatttcttgccatcaagtgttcagtttctcttcttggcatttgtcgtcttggtaccttttttctttcttgatttcttgaatcctgctccactctcctgtaaacatcaaaggcattcagtgctacatcacaaccaaaaggacaacaaaacatcagaatggtatgcaagtatatgtaccttccgatattgtctataagcattgcggcctgtcaactcctccccacttttgttgacataaacctgcaaggggggataaagaatcaggttctgatagatttatacaatatgacaaaatagacttaaaagcttttctcaattatggttctggtcctataatttcaaaaccactaggaattggtccctgccattaaacatcaagtaggaattggtccctatataacaattaatcttaatgtcaaaagaatgtttacaaaaacaatgggagattgagtatcactatctagtgttacatagttatattggaatgatgggatcgtgtgcatcaaatcatagaacaatatttccaaaaaaaagaggcattatgtaatgtgataatttgaatttcattgcacttatttaaatcttaagtaacatactgtatgggttttttgcatttcagttttaaacaacagcaaaacagctcgcataacttcttatgaccagcatctaacatgagaaaagtaaataaatttaaccagttaatacttaataacattaaaaaaaaaataaagattttttctcatacttttcttccttctggtgatgtaaaccaatgaccagcagattcaccacttgcttgaacacgccttttgcctgcatcctttggcaaactggtgcagctcctgggttccacccagcccccagaagcacatgattggttcgcagggtttgatttgtttgctttactattactttttgagacactattcttagtgccattcctctttgttgctttctttctagaagattccccatggctgaatggagaaacaattttgggatccacccagcctccagaagcatcaaaagatccctcaacattcaaattacttgatttgtttttcccccttgttgagctattaataaaaccattttgaactccctgcatgtttgaagctcctccattaccaaattgtcccctgaaatcaaaatacaccaaaacaatatgtaatacaaaatgacaatcactttctttttaaatcattaccataagattaaaacaacaaatgaacatgggttacgacttacatgtaatcaatgtgtgagaaattacgttgctgattcactgtgttgatggtacctagtggattaaaattccgcaggcgactgcggactaactgccgaattctcggatcctcatggaaaaaataagtatgagcgggatgaacagggtctgttgattcacatcgttgttgatccctctggcagctagaactaaccccaggattcctctcattaaaacttttagacgaatcaccacccacttccttgcaattggcagaacgaaagtactcttcacatatctcattgaaggcaggcgtcgggacagaaacattcttcaccggcaaaaaatccttccatagatcatcagcaggcgatgttttcttattttgttctaaatggcggttagggttagctttattggcaccagcaatatcaacatcaacatctgaatcatcagaatctgaaagcaactgaaatttacaaacagaaacattcttcaccggcaaaaattccttccacagatcctcatttccattcacatcaaccgaagttttattatcttgttccaaacgactgttagtgttaactttattggcaccaccgacatcaacatccgagtcatcagaatctgaaagcaattgaaacctattaacagaaacattcttcaccggcgaaaaattcttccacagatcctcatttttgttctcgtcagcagatgttttcttctcttgttccaaatgactgttagggttaactttattggcatcaccagcaccaacaccaacatcagcatcatcggtgtccgaatcaatcaattgaaaccttcggagaggactagtggttaacttgggaaacatcaagccactcttccctgtctctaacctggcagaagccggaacatcattggaaagtacctttcttttcctatccctgaaagagttgctacacgaatgaggggtcaaaaccccacttccattcaacgaaactttcgagctgctacacacagaatgattccgattccatgccgatggaaccgcatgccctaataatattacaacagataaataataaggaaattattaatattattatttaaaattgaaaagccgagagagaggtgaaatatttgaagtgttagctaacctgaccttgatcgggatcttcttgagaggagaactcctcgatgtcgtcgtcggcgtaggcatcggcatcggggtcgagatacggcggcgggggcccgcgacggaggcgtttgaggagggggcgcggcgggtcgggtcgggattcgggatcggagtcggagacatgaagatcgggagaaagaggtggatggattggggaatgggggggcgtatcgtcgagacctagggaaaatgagggcacttcgaaattcgccatggaaattgaattgagatgtgtgtatgtaatgtatataaaggagggtttaggggatttgaatttgggggggaaatggagggaattgaaatttctggttcgcgggtgcgcgactgaaccatcttcaactctttttttctgtcttctttttttatatgacagaatcaagatttacataactcactttgttgaatcaactgtaagtttcattttttattctgtaagtttctttttttcatttacaataaagttcttttttattctgattttattgcttttgctggaaaaatgttgtgaacgtgataaaagtaatttttttttcttcagattttatttaatatttagcttattaatttattcaggataaaaggcattatttttattgttattataattataaaaataaccacaaacataataaaaaattaagtcaataacagtcaaactatctttgtagatcaccacatttttatgtttttcagatggtataatgtatttaaatattaatttgttatatcaattaatttcaataaacattaaataaaatcaaaatggaaggatatgattataatttgaagaaaatttaagtgattaaattaacacaattaaaatttaaatgaccaaactacacaattatgataccaaaaaaactaattaaatatcttaaattataacatttttacataatcttttaaaatcataattcattacattctttaagaatgcaattaaatcttctttttttcctctaaaaatatattcttttaaaaaaccaatgattaaacaaatttaattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatacatgtatttaattaccatgataaaatttaataactttataattaattattatataaaaaattcattcacacctattaaagtgaaaaagattcattctgatttattcacaaattaacattcacaaaaaacttttatatccaaaaattatttttattattttcctctaaaattaaacacatcataattaaaacttttaaaggtagaaagctttccttctcgtgtaacatcataaaattaaaacattccttacgttaattatcacctcgacttaattattatcagcaaacaaaggaaaaatgctaatttcaatttcattgtttttttttatactttgacaacattaactatcaaaatgaacaataaaggagacaaacagaaagaggaaaaggtccagtaagtattaagttatatttttttgtcccggaaccacaaatcatccttgccacctcctaaaatacaatctacaagaaatcctaagcaacatacacaatgatagaaaatcaaaatcttgagtagataatgctatcatctatattatatgacgattttttttcccatcacatttgtcctctgaacataattgataaagtacaacacatgctacatgcttctcataattttctcaagaccctacccaatgaagaagggcctgtaatcacagatgacaaagcgagctatttcccaagatatcccaggttttgaggaatttagcacaagggaatgagaagattatctgcttttaaagcttaatatgaatgataatgaagaactgaaataaaaactagcatgaggcagaaaatgtgcatctattcatgacccctcatcactgtgagcagatttttccataaagcagcatatttgtaccctcacaatctaaaatgaactgcttttcatcaatcatttatcaattttacaggttggcaatctgtgcaatgcctatgcctaaaactaaatcttctgtttaagaacatggcgcaactgaaccttctggctttccattctggcctccataagtctggctttcaaactattcttctgtgcagtgcgaggaatgcatcccttcatgccttgatgtgcatgtggacttcctgactcgggactcaactggtatagaaggtcttggggactcagcccacctttacctgatccatgatcaggagacatgatgacaccattagataacattccatttgaaagtctcccatttattccctccaaagagattatcttgtaattgtccccattgtttgagtatgttgacctccaaagcttcgttatggatgataccttttttgcttgcttcgttggtatagagcacacttcacttatttcagttattggtgtctcctcacctgcagtttcttcccattcaagtacacttctccctgagacgttactctctcggtgattcctgttcaaagatcggctactcccttctggtgaataacttgagccttgatcgtcgacatggctcacagtctcccatccactttcatctccttctatatccccattatcatccataaatacatcagaacgcctctgaatgccacctttacttattgcattggcttcaggactcaccatgtcaatattcgaggcatgactagcaggactgtgagaaacacatggttcaatctccctcttatttacttcaccaaaatttgcatcttcaaaaatggcaaaaatgtcatcagagttagggggttcatatgaaaatcccttaatgtcttgaatgttcattgcagctgcagcctgttgaagtgactgtgcctctttcatgtccattgtgttcggctctgtgctttttgacctgatatagctttccaaatctgcaacgagtctattcatctgtgcatacttctcttcaagagcaactttagcatctatcaacttcatttgaactcgttcttcacgccatacttctgccatctgtaacatcttgctctcctcttccacttcttccctgagtttcatagattccctcttcaatgcttcaacttcagccttgtcttctccaatttccttggcaagctcatcacacacttcctcgatcaattctctggccttcctttccttctcataatcctgcatgtagcgctttgcagagagtttgacatctgccaactcattaaccaacctcgaattgacaatttcaatcctctggcgatttttcctttctcgattcaactctgctttaatgtcatcaatgtatgcgcggattttctcatgctctttgcttctccattgggccctttcctcactgactttcttcagaaaatgctcaagcttctttttggaggagcggtgttcagtctcaagttcctgaattcgtgtttgtgcctgctctagttcagcaccgagagccgacacaacagatacagcacttgccttttggtcaagatgtttcatgtggctgttgatatgctgcgcttcctctgatgtttttgaacataaaggattccattttgttgcaccctccatttcattgttgggaagctggaaacgttcaggctgaatagcataaagtaggtttaaaattagcactttaattgtctgctctttcacttttagtgtagaagcagaacactttttaaaactcttttgctcatagacattggaaaagctaatttcaccatgtaggtttacatgaaaaatgttttatctaagccatctctatactgttatacatagcatgggtcaatacaacaatgagcataatttgtttcaaagttcaaattgggtggtatcaacccataatatgcatgtgtttgcatgggcaggcctttgaaatattactaaaaatttccacaatatgaaatcataaacaacacgttgctatgattatagtttgtcactatctataacttaataattagatgattgatgtcattttcacaaagatgattaaaacaggtaattgcatgactgagcaatgggatattgggatcattgtgcagtacaggttgcagttttaacttgagttattatgtgtatatgacattcagtcaataatcttcaattacaataccaaagagctgtaaaactcctaatggttatattatattgatattgaagtagtaagaaaaatcatacctcacagaagtgtccattctttgtcccaaatatggaacggggactttgagatggattcttcttcagatcagaaccatgggtcatgccattaggatgaccgagaaactggagccctgcgtgaccaattccattctgcagataagtgtcatcagtgatcagtaatgagaaatggaaacctatgaaattaatattgtaaaccagctacattgatctacaaacgaagacaataataaagtgcatggaagataatcattctctaattcaactggaatgtacagagaacaaataacagaatctcatataaaacgaagactcaactaaagtcccaacttactctcaaaaagcacaaaactgacaaaagaatatgagttcatataagccaatattattacacagcatgtttgtttgacattctgccaaacaagacgcaatattcaatgcactctggatggatatgatttaatgcagcacgaacggaagcaactgattcttcctttctccgaacacaagtttgcgtttagggaagaaatcttcaacataacaataattatttacaaagacaaaccctactcaactcatttctccaatcattacaaagactaataattagtcctccaccagaaccacatcactcgcgagaaaactaaaaaaacaaaagcatttgtatcttcaaaaggcagctatttttaatttcatagaaagcctaatcggctaatccctaactctaacaccaaaacaggaaagtgaacaataatgacaaggaaccaaggatagaatctgaacacccacgattcaaaatcaagcaacaacaaaatcatcatataaaaataaataaaccccaacaataaactattaattcttttttctccatgaggggtggcctacaatacagtagatgaagtaacctagtagcatgtagctgcaaaatcacatttaaatcaaaaacaacaaacacatgcaagatgcaacaacacgcacacgggaacgaagaaaaactagggatcccaaacaacagaaagaaagaaaaaaacaaaagggtaaacgtttgagatcccacagtgaccagtgtcatagacaaaacagtgtatataagcagagcaaaaccctcgcagcaaaaactaggttttgcgacttaggtccagacccagagtgtaagaagagtagcccaagttatgttccaacctaccttatgttccaaccccttccggccatcacccgtggccgtctccggcagatgcaaccgccacagcccggcggctagtctcctcgccgacacggcgacttcggcttgcttcttggcgctccggcacgttctccggcgggacccagcgacggaagacttctggtcgtcttcgagtggatcgtaatggatcttccacttcaaaagaggggtttcgggtctgctccgtttgccaccgtgtctcctcaaccgtgtccccggagtcctcggattccgccgcagaaatggcttcgccggttcaagatctgagtcaggcgaagggttgttcacgctcctcgaagcaatgcccgccggaaaactccccttgccggaaaacttcatcgtcgccggcgagtctcagccatttaatcaaacaaacaagagttacttgcgagaatgaatggcccaaagagataaaatggaaacagagtgtgtgtgtgtgtgtgtgtgtgtgtgagagagagagagagagagagagagagagagaggagatagaatctgtgtgttgttggagtgatggagttcgtgaagtgtgtgtgtgtgagagagaggacacgaggaaagtacagaagagagagagggagggagagtttcactgtttcagagattttgctgagaaaaagacgagcacagtgacaatacaaatacacatacgcaaagaggtgtacgtctttccgtatgtttatacggtcaacgtatctgctatcagttatcatgattccacgcgcggggaaatgttatacgatgtcgtttggccctacttgatttataagctacgatgtttgttaaggctgctggtggaagagacgttctgattttaatgatctaaggatggtgggggggtttcttttacattttatttattaggatttatttcaaggacaatgacgttaaaatattaattaatttatatgtgaaaaaagatattttaagatgaattcaagaaagatttattttatttaaataatgaaatatatattattttaaaaaattggatcaatttacatttcaaatcaattttattcatttttattttttattgtttattactttcaaacataattataagattttagagttcacacccttttaattgttccttattaatttttttgtgtgaattaggatatttttaattgttttctatcaactaaattaatatttgttaacagataatttcatttaagttaacaatatttttaatataatatagagaaaataatatttgtttacataatatagaaaatcagatatataatatctaaatgagtaaatgtcaagggagtaattgtaaattctcctgacattttctattgatagggatgacaaaaatacagtatctaaattaatcattaaaaaaaattgattttaccatttatgtggttaatttgacttttttttaatatttttagttataatttgaattttaatattttttgtaaaagaaaatattattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccaattttacttattgctcatttagtcaaattgaaatgtatattatttactttgaaataatccaaacattgcaaaaaatgataaggtttaaaattacaacctctaaaaaaagtttaaaattacaagttcgtattacttaaaaaagaggtggatttgttcatttatttcatatcatagagattcgatttactgttattctcgtagacaatgagtatataattaatgaagcaatcaaacatttatgtcatcgtcagttttggccattggccaaatcagaaaataaaaacatctaacaggaatcaatgaaattagaaacaaaaactattagaaatccaaatttgaaagaaaaaatcctgttgattttttttcatttttccctgcaagtctgaaaattgaaatataacactatggtatcgtcgcctataaaataaaataaattgaaatataagagatcagtgataataattgttcaagcatccagaaaagaaaagggtacaattttccatgcccggcgtctacagtgggaaagtaaggtaggtttcccactgtgcgtaagtaactgtgattttgagatatatgatagacaagcatatattagatttttttttttttttttacataatgactcttcttcttcattagcatcatcgtcgacctctatttgtcgtcgttggagatgatttctcacaacatcatttttttttttcctactttcagtttttcatttccctttcttttcttacgctctccttctccaaccactgagcgcagatccgaagtgaaatctaaatatgaaccaaacctcaaacattaatccaaagcaaaaaatcaatcgtacaaaaaaacacacactttcattcatgaaaacccccaaattcaagcgaaatttgagactctttcgtggataggccaaccccagatccgcgacaactagcatgcgtcatcgacgccaggtcgaagatcagtgcacgcaatcaaaaggcgtaaacttagaaggattaatctcccatttagatctcattgttggaattaactggaaaaagggatggggaaccaaaggtgtagtggacaacggatgacgacacctttttgtaccttccttcacaaaagttccaagcgatgtgttggagtacgatgtggttgacaacactggtggcgttgttgacgatgaaaatcttgtcgacgtggtccttgaagatggttgagattggaggaaaattgttctaatgtgtgtaaacctatgataatcccaaacataccaaaaaagcatatagatctaatggacagtaattctttcccacggtttaggtctccaacgttagacatcgccctcgaaccaaatgcatataactaaaaaaaattagatgttcaaaatattcttctttatgcaaagataggaagagaaattttgtaagcagttttacttttgttaaacagattgtttttgaatttttctttatgcaaagagaggaattatataagcaattttattcttgtatacccaaaaaagttattttcaaatttaaattcataattaaaacaattttattgttgtgtgtagtgttattgaaatctgattggatcggtcggtctgaccggttgaatcggaaaacgatctgattttatcattaaattgattatgcagtcgacttgatcaaactcgatcggtcggattagatcagcttgattttttatgtacttttttgagatgtgtttttttggattttggattattatcaatagttattttgaatttttgaatatgaataattttttttactcaaataatattaattatatatttatatataataaatatatataattttaaatttttaatatatactaatttaaatcgattcaattattgatccattaattaaatcactaaactattaattcattatttcgagtagttgaataatcgaatcagttttcctaacgagactcacttcaataaaatgcatatgtacttcaataaaatgcatatgtttatttgaaaattgatcacgcgcgaggagtcggtcgtgtagggcacttcatagcaaagcaagtgtcgtcagtgtctgatctatttgttgcttgcacacttcaatatctactctgtttcgccctagacaaaaaggcatccgagggagactccacgtggcaaccaaagagactgtcacgtcgataaatacaaaacgtgcgctccaatgctccatattaaaaaaatacgctttcacatgggcttcgaaattgattaatactatttattttaatgagccaaccctctataaagtggcataataagtgataactttatttttttctttgtttggtacgacttcaatgcagaattagatctggatagcttattaaaattaaaaatcttaaagtaaacaactggaaaaatggttaatggctgcgcatcctaacttgattttcattttcattgccattgttaggtttccttttttctctttaaccatcattggattgtaagctattatatgaagggttttaacttttaattcaagtaatgctaagtaaattaagaaaatacgtacaaccaattggatataaattcttttaaattttttcaaagatgcatgcaaagcctaagtgccaaccaaatacatgggcagaaactgaaagaaaaaggatacattcacagaatgtgaggttctacttggctcgtcgctcttgtggggcattaccatcatgggtccaaatttaatttatacgtgattctttaccattttattttttacttttctatctggagcatgtgtaatttaaattttcgttctaaattatgagctaggttggacttcctcagaaataaaatgtttgttgaatagattttaaaatgcatatatttattacttactgtgtgaatgctattattttctaaatgtttattttgttgtttgatttagtttgattcgtttcaataaatatatgaaattaacaataatattcctttaatgaatttttttccctttgatagaagattatttttcttcgctaaagatgtgatcttaggaagatattttaaatatttataaaaatggagtatttatttttatttccgttattatctttcatttatttgtataaatatgtgaatgaaataagacaggttaagatctttttgtttcccctcatcacgggtaatattctttgatgtttatcacaaactcataaacttattaattaagtattctctagatcttaatcttactctccaaaaaagtattctctttatctttaattaacattaatagtttttttttacgtaacctgagtagttgtcttgaacaataaaattaattgatgtaaacataaaatcgttcaagtgctttgctatataaacttttaggttattgttgctttaattttatcgaacaacatagacatttttttcgattattatattatatgaaaatatataatgtgaaaaataccagttgatgcaggatcacgatgtacatatattgtctacatgcatggaaaattggaaataacaagagcccacgttcagtggggacttcatgtccataatcagcattgataaaataatagactatgtacgtgtcaggactcacgtgcaatgatgaaataatcttttcgtagaaagatagattatatttatataattaagaaaatactacataattatactatttttttcagcatatggtaaaaatgaatgtgaaagaaaaaaaaatatattatagaaattattttagaagttttttttatgaataatataattctaaaagaaatgataattaccgatagttataattttgttcagcaaaaaaaaatgaatatgaatatttatttttcttcaataaaatattttcatatatacagtcaaaattacccaaatgaatatgaatattgtatatgatcaaattccgaccagaaaaggccacgttggcaattaacaaattatcttttacgcagctttttcgtttttttttttcaccaccttttactcttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatattatacctaataatatattttatatatagtattttatatattatattattttttatactagatacacgtattatgatgtcatgttattttctaactcagtttctttcaaaagataaaaattacgctaaattaacaggatagattaaacaaaaagataacataatcatatccggccaatacatcaaaaaattaattacaattaaatatgatcgttattttattctatcctactttaaccaccaaattccctaacctcccaagtcccaccacaatgaagtttgcctttttcataagatcacgttctaatgtttcaaagaaagaaagaaaaaacgagacaataaaaaactaaaactacttcgttgaaagaaacaaattatacattagtaatttctataatttgaagaaattaatctctaactaaaaggatacgttcagttgttaaccccccaaccccacttcaaaaataaaaaatgtcgtgttactaatcaagaaataaatttatataagggaacgtaatgaaatagacaatgctatcagtttctttcaaaagaaaagttttgaaagaaactgacagaagagagattatggcagaaaagaaagacacctgatatatagttcataagaatggggagaaaattatttaaaatggtcaaataaaattaagttaaaagataatttagtctacctaatgtaaaagtggtccagtccttcaaatctctccaattttgagtgaacaattttaactaccttctccaaagttttggatcaaacaaataaaaaattataataatacttatcttccattcccccttctatttctcaccaacggaacactaactaaaggtcgtggagataatatttcaaagcaaagccatattatatataaaagacaatatacaactctatggctatgtccatcttcaacctcaaatacagtgtgcacaagctttgttgatatattaacaaatacttactaacaaaactatggactttcaatatctgaagaaccggttgcattaatctttgaaggcaattcacttatggcaattaaccatagcaccgaattggatcattgcagcctttagaagcagattgcttgaaaccaaatcggccacctttctcaaggtactgctgatggtactcctctgccctgtagaacttcttggcaggaaggatctcagtaacaatcttcctgttcaactgcttctcctgttgctccaatgactccttggccgccttctcttgttccggcgtgtagtagtatattccagatctgtactgtgttcccacatcattcccctgccacacaacaagatcaaatggtaactaagcgcttaagcggtagaatgtacaatccatgtatgtgctgctgcatatcataactagtcaccatattttcatgtgtgcatggatttggatggaagagtgaattcaagaaacaaaattattaagtatgcatattgaaaggggacaacaaaagaaacaagggacaagacaaaaatgtagcaaaggaaatactgaaatagattactccatatggaaacttatttttggatgctcacaagtcattctagagagccatatataattgaagtccaacataagaagttggaactagtacattaccacactgaaattaaagcaaaatcatcattgcaattaactcctaaatgcaactgataaatggagttacagaatgtacaaagaaaggagacaatccatcggatgttaagatattggatcaatgataatcataggagctggggttcattgcaggttcttttgaaaacagtgctcataagaagagatgttttaataagagagtttttgctgacaagaggaaaaaagaaataaatggatggattggatatcttacccatgaaacattattaatggatgggttgggatttttctttatcatataaagtcatggatggtttggattttttttttaataaatttctaccacatcataaatgaactaatggtttatttttgaaccatctattttaatccaacttaatttatccaaaccatctattacattacacccctataaacatcccactaagtgcaaacagaagggtaaaaacaacctaaacaactattaccaagagacccctgcaatttgatgcgacccaaaattcaacacaatatcatattaaaacagaatttacaaaacagacatgactagatatcaaaccataaatgtatctgttaaataatggctacatagagaaaaccaaaattactaatttactataaagaaatcaatcaaggaatcaaaaatcaatcaaggaatcaaaaaactgttggcaaaatgtttaactctagaagtaatgcatcattaaacaattgtacagaaaccccaaaagtaacaaaaatcatttatgctgacaatacacaaagtccagacctattattcatatcagaaaattctagaaatatcaattagaaaccagacttcctcattttttacatgataccgtgaataaccaaaaaaaaaaaaaaaaaccaaaaaaaaaaaaaaacttcatatatacctgtctattcagagtggtgggatcatgtctagcccagaacacgtcaagcagagtctcatagctacaactttttggatcatattgaatccttacaacctcggagtggtttgtggtccctgtacacacatcctcataggttggattatgcacaagcccctgggtgtaaccaacctctgtcttggtcacaccaggcaccctctggaaggccaactcaacaccccaaaaacacccagcaccaaactcagcaaactgctggcctggtgctggtatgtcatcatctggaccctgaggaatggatgaatccatgttctctggtgctcttgcgctgccaaacccgagtctgttcaacaggttcatggagggcttgttcacggcaatgcgaggacgagtttgggaaaggaagcacggacgcttgacagaaaatctagaaagtgagggcaggaacttggttttggcaggacaggagagggaagaggaagcaaacactaaaagcaaattggacgtggtggtgtagctgctgctgattgctgctaaacatttgaataacatgagagtccttttctagatgaaataatcaacttcaaaatgctcttgtatatatgaaaaaaacaaaagagccaccaaatcaggatgccaagcaactgaagttacaaatttgaacagataatcggaagtttaaaaattaattttgaatcactcatccatatggtgctacatttattactataccacatggcacttgtatattggtaaatggtaatgataaaagttttacatgaatcaaggatcatctgaactaataaaataattattctctgttttcattttgaattctcacatataattacaaaaatatcatcttatgcttactttgttccctattgtcaaggatttgtgctaggaccaaccaaaataatttgtagaacatggaaaatagtaaacaaagtaaatgtaagataagatttttatatttatttatgaaaataaaaattgaatacatatattttctgaaaccaaacacgtcctaaattttataaagataattaggtttaaaaataacttaaactcccatcccatcacatcactttatgttctagtcctaatcacatatattcctccctctaacttttggatattttttcttatagtatatgtgttttccctctaacttttggatattttttcttatagtatatgtgttttctcccccaaacatggactacaactttacaagctgcagactcacatacaactgtgcctactattgaacactaatttaacacttaaacacgccactattttttattcaaataaaacaattagccgatactctttctttcatgcatgtatgcaatcagacaggaatagagaaaaacaaatccttgttatgaaatatagaagtgatttatggtttaactattagcactcacttgggggaagaaaaagaagacaagtagtatagtataagattccaatttcatagaatttccaataaatggaaatccgtattgggtcaaagattgtgccaacaaataaaattatattttctcatgcaaacagctggcccagtgtgcatccattgctattcataaattgggaattggaacagaatcacataaaaataaaaccaaactcacaagacccagaattgggtgcataaacatgaaggaaataagtccaccaaataaattaaaggaaatccaatatcaacccatacctgctccacaaattctcatcttcaacccttcaacaaattacaggaatcaatctccacacaataataaaggtaatttttttaacactaagaagaaaaattgaactgaaataaggagaacccacaattcccttttcctcacaggttaaaaggaagagggaaatgggagaaattgaattgagaaatgagagaaaacgtgcaattggagaatgaagaacacaacaatacgtaccccaagtgactgagtgagagagtgagagagtgagagcagaagagagagaggttgctggttgaggattgagagaagatgaggatttgatcactgcaaaaagagcgacccttggacctgaacaatcatgctttatcagtttatctctctacgctggcatcaatcccgaaaatacttaaaagcccctccccaacttaccaccaccctttaaagtgtaaagggtaggacgtcatttcccaatcaaaatcacattaaaccccatcaccttcgtgttggagtttgcctggaatgtaacgactagaatattacacaaaatagtgcatctaagggtgacacgtcatgaaatatggttcatgtattattttttcacgattttagagagatgatgtataaagtaaaaaaagtgcaaatttcaaattatttactttttattaaattaaaatatctcacaatttatcaaaaaaggcatgaatcaactggccttgataatataaaatttagtgttatattttttttaatatatatgtactaaagattcttttgaaaataaaataaatcaagttaatttataaaaattgtttcatttattataaatactttttaattaatatataagttaattttaacttataaaaattgattcaatttatatttatatttttataaatatttattaaaaaatttattcaaacaaaagctttacctcttaatagggaataaatcccattagaaatgcatattctgattgatatcttccaattaacacaaactaaaaagccccttttatctagtttgtgttccttttttttcttgctgctgttttatttttcatatatgtacatagaaaaaaacacggaacttctttttagtacctttaaaaagaaaagtttgggtcactactttatgtaaacaatatcatttctagtgtgattatttctatttttatagctataggtttgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaacttaatataatatatttattacgttgttatcagctttttacgagattttttgtgagtggtgtgattagctccttcgttttgttaatgttcttatcattttcttacgtatagttgcaacttttttacctattcaaactaacaaacaaatcaattcacagggcgtttgtttcactaattatttctttaattctgaaaatattttttcttgagaatatgacatagaaatattcttcacaagtattttaaaaaaatatattatatatctgataataattattttattacacctcataataaatatgagagtaatttttttcaatcttatattttcaaaaataaaaaataatccgtgaaataaatgcgttgtagtacataaagattatgatgcattcttcgggcaaaaggaaaaaagagattaggattcttgtttagtcttttctttagtttggattagaattggaattggtcctttacattttggttttcctaacgagggaagttcacaaaggaaagtgtacatttcttcaaggaaattgttcgtttctttttttctttacatcgagctattgtttgtttagcatttaacaacgaactaaggattaagttttgaaaattttgaaaaaatggttaaatacagtaaaataggatttcgtaatttttcaagtttttacttatctagttgaaatgtgataaagttaagtttttttcgaagtatattttatgaaggttttttttaacctctcgccttaaattttgataaacaaaaagaactaaaattggattggcttatttatttataacttttttgtgaagagatagagacgggttatgtatctaataagaaaaagagacaggggttgtaacattggtcttggactgtgccaaggccatggtacgtaaactcaagggtaatatacccagaatttttttaaaatgccaaaaatgctctcacgttatacaagcatggattcgcgaatccgtaaggtccatacggattagctcaatccgtaagtaagctttttttttttttaaaaaaaaagttaaaaaatatttttccaaataatttaaaataatagtgcatacaggttttgaacctgcaaccttcatgttattaacatgatgttccaaccaactaaactaatagatcaactatgataaaaatcaattaatgttgatacatatatcattaaatgttgtaatgtatatttaatacacatataaattaacataataaattttgtaacaattaattttgatataataattaaagtatttttttacatataaaaatcataagtttaataaaaatttacaggtttaataaactgtaaatacatatataatttttaatttaacctataaatacaaatataatttttattagacctgtaaatttttattaaacttatgatttttatttaaaactatgatttttatatgtaaaaaatactttaattattagatcaaaattaattgttacaaaatttattatgtaaacttatatgtatattaaatatacattacaacatttaatgatatatgtatcaacatgaattgatttttatcataattgacatattagctcagttggttgaaacatcatgttaataacgtgaaggttgtaagttcgaaacctgcatgcgccattattttaaattatttggaaaaatattttttaacttaaaaaaaaaaaagcttacttacagattgggccaatctgtatggaccatacggatatgactaaaaaaaaaaatctcacgaattcacgaatccgtggttgtataacgtgaggacatttttgatattttaaaaaaattctgggtgtattagtctttatactggtgtataaagttttacctaaagttttaccctaaactcaatcgtgtcgtgggcttattgtcttccaccagccgaccgtaaaatactctgggcttataagttcggctcagaattaagcccattagggtaagaaataagtgtagcctcaacctcaatggtctggtctgaagtgaactgaattataaaaaaaaaaactcactgaactgattcaactcaaccgaataaaaaaaaggaattgagtctacactctacatattaagtaatgtctctccaagaataaaggataaaaaaaggaggtctttaattagtaggtgtcggcaaacaattttttaaaacattttgtggtcttattttttatagaaaaagataggggtccacttaatgatatagagtcaaaagatgatcacttgataactgcaacatagcgattacactatgtagtagatagccactcaattctgtctttgtatgtatatatctttgaagaatattacaacattcattttatattgaatttttgtcctatataacgggcattgccagtaatttttattttatctttttatatcaagcaatttcccaatgcaatttgtatgcatgtgtttaattcaaattttatttttatttttatttaaaattgactttaaacttaatgttcaaaatgaaaactttgaaattaaaataaaaattatttcacatcttttatttcttttaatttaaaagaaatgataaaacaaaaaggagaagatagagtaagagaaaatgtaaaaagtgactcaaaattgttctttttttgtattgaaaatctacttttttccgaacatgattcttcagcacacattgattagtacattcagtttaatatgaatatatagaatggagatttttttttttgggttctttaacccggccagttattcttgaaacaatcttcttgtgttgaattaattgggactcccaagtcctgtttatacaagagtaactaacattaatatgcaatgatgtaagttttggagtctcttaaccatttatggtctgactaaaagtttagatatggaccagagtagtttttttactctatataatttatattactgcttagaaaagaaaaagaaaaaacaggtaatcaacattaatatgaatgtaatagattgactgtagtgtaaatttactgatctataaacaaaagtatctggctacaaattagtcctaaaaaactatatttacaaattaataatattaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatatatttattattgtctcatttaaaaaaacaaaaatgtaaagctcatcaacaacaaacataaaaaatcaacgggcgttagtatatatgtaatatttcccaataatattttgtctatcacttaatattaaaaacctttgacaacatttaaaaaatatagttaaattataaataaatattactaatatatttttgtgacattttatccaatgttattaggtataacccatgttgttaaagtctaaaaatgttaaaaaagactttaacaattttgatataatgtgaaaaatattttaataatatttatttatgatttgacgataatttttaatgttactaaagatttgtagtaatgtttttattaataatgtttgataaaaaaaatgtcaatggaggctacatatgcagtagttgacatgttctgcagtccaacatgtatgacactcactcagatgtgacttatttaacttttataattcatattttcttatatgccatgcttaaaacataacgccgtttattactttgattattcaactttgatacacctaaacgtggaaagcagaaaattccaactacaacctattgtgcttttacaagtcctaattaattaaggccgttattgaaatagagtagtacatttgacgcagtagttgtaaaacgagcaatcaacatcagctacacgcggtgatttttaattaataatatttaaggaaaattaggtagctactagaaaccaattgttttcctttgattagttaattaccaacacaggtacacaactacatgcacaagtcttgggcaaaatactatgatattcatttaaaatttaaccctacaatgttgtcaaatgaaagccaagtaaaaacattaatattttagctagagtctgcagctaactgctgcttaattaagacttagaagtcaaacaaagggaagatagtagtcaacaatcgccaagctaaaagtcatatttgaattgaccatataatatataacaacaatgaaatggcccagaaaagaaattaagccattgggagattaagattgtaacaccccttacatgcaccgggtaattaccatgcttacacatacatcagagattagcagtttggaaacaatataacaaaggcatcatcaaatgccgtaaacatacatgcgtttacattataatatggtgtttatacataagtttatgtaccattacaaaactgtacataaaattttcctcatggtacatcaaaaccaaaccaaaggctaatacaaaatatctgagccagatgctcatgtcatctagcctaagatgtatgaacagtgctatccctgcataggcttcttgccttgggatctgtccgctcctactgaggattcacctgcaaaacataagccccacacaagaggtgagatataaaatctcagtaaactcagggcccttgaaggtatttccttcccctggttcactttcaggcacatacatagaaatagtacattatcatcaatcacagaacatttctcattcatcatgagaacacacagggtctaatcccctttcacacataccatttctatggtttcaccccaacccgtctacaaacaggtggtacacagcacattaccaggcagaggctacatctagatatataggaacatctccactcacagaggctacatctatatactaggaacatctcttgcccggacaacaacatatctattggaggcttcatctgaaacataggaacatctcagttaagaggctacgtctatgtaacaggcacatctccatctagtgaggctacatctgtgtataggaacatctccattcaggaggctacatctatatcacaggaacatctcacatcctataccaaccaattgcctgaggaggctacatttgtagatataggaacatctccattcgggaggctacatctatatcacaggaacatctcacatcaggtcttactcaatctctcgtaatctatcctactaccataggattcacaattcaatctcataattaaacaggcatatcaacatacaatttctatatacatgcaaatgcccacaatagaaccatcaccccaaacttggtgcatggtggaacacaacaaagggcatacaatcaaggatcaagagcttacctgctctgagcaaaacaccggctctcccggcctcactatcaccaccaccgaaactctcggtctcacgttctacatcacatcaaatacagcatatcaatgacggtcacaagccgttttaaacgaaaggagttgtaatccttccataggatacataactaatcacttcacaaatgattcacagcctaaccacggctccagagcctcttctaagactccgctcatgctaatacaagcataacccagaaccaaaatcaaacttcatcaataatgatttctgaaggctctaacatcatcacaacaaccccttgaacataatcttctacagaacccagagctaactctagccctatcacaaaagggttactattcatgcgaatccccaatttcacaaattaatcggtaaaacttaactttcttacctcaagacagtcgtggagggctagagaatcacttctctaggcttcaacgtccgtgaatcacttccttccccttcaaaatccaagattttgtaaaaatcactgtagcacagtaggaggaacgacggtttcggcaaaatttcctgcagcctcgcatatatatagactgctacagtaactgctacagtaatatgctacagtaatatgctacagtaaccccatccgtgctgctacagtaactcaatccgtgctgctacagtaacccaatccgttatgctacagtaacatgctacagtaattgctaacgatacccagcaattactaactacacccatgcctccagcaatgaccaaactgccctttcgtaaattcgtttaattacgtaaatatttcccaaaattccttacttaaatttagtgatattacaaagatagccatggcgcccaacatttgcatgcacacataaagtcatgagtggctgcacgtatttcatgggtgcagcacgtgatccagcattcgcgtttgtgcaagaatgattcaaggttttgatttttagaaatttacttatattttggataaagtttcttagaaatttataattttttaaaatgtatagtttttttttcaatcattatttagtgattaaacatgtcaaactctaaaatatcaacatatataaatgcatgttacattatcaataattagagatagagatatatacttattacaattcgaaatcgtgctatgcaaatttgctttaactttaactatctaaaagccaaaaggttgactacaagctaacattcgcttttattcatattcaataagaggatagcacgtttgaaatggcaacgaaaagaatcttgggacacaacaacctagtttcatatttgttcttccccagctcaaggcaaaaactctgtaaggtggattttggaaatctatatgattttcttcgtactagtccagtttccatggagcatttgcaatgattttgacgattaagttagtatttgcaatcgtagataaagtgtgtaaatttatagagataattgtttacttgggactggaacatgttcttaggtttacttctaaaattattattgagttaggatggtgtctcttgcatgataacgcatgttaagtgtctttaaggttaatcccttgatttgcagtaaggtattaataaattgtgttcatcatctcgtgcttttgtatttgcatgaattttatatgcgtaagaatatgatcgttgaatgagaggggcattgggctatgataaggccgatgagtattagtaaaattaatttcaaatcatattaattttaattaaaatattaagtttttttttttatattataaatgcaagttagtagtgaaacttagtataaaagttatctactcaaaatcaattcatcaaaagtaaaattaaatatatatatatatatatatatatatatatatatataaatttacatgaaatcacgttaactgctattgagcataattttaaaacatcccaagtgaaactaaacaaatactatatcattcaaaatctttaaacacattaaaaactcaatacatagatatacatatttttttcaaccatcgcactggcctattaaaaaattgagtttaatatattcttagtttttgcaaatataataagttttaatttaattctttaaaaacataactataactcctataatttttaattttttttaaaataatccctatctcttttttctttttttaaaaaaaggaagaagtaattacggtgttatgtaacgcatcgttgtagtccttctggcttctgatatatataacgcatcaagaatgtccttgagattgagaataggtctgagaggaacagaggaggtaaaaccgatcgattttgacagtgtgtatggaatccaaataaaaaataactctatataactaataattatggatttgactatgtcgttgtttaaatgaaaagcgttctttaacgatcgttgtttattattgatcatttttccacaagagtcgtgtagggagtatatataagctacatatataattagggttatgataatgaaaaaagtgtgtttgggtcagccaaatagaaattgcacgtgaaaggaaggtagccaaacagcaccttcactcaaagattccgttccctaatttgtgttcacacctgacgtggctacttctatttgaaacttgtcctcagattccaggtttacccttttcacacctaaaacctaccaactaattcagcttttattatcactttatgatcccaccatatattttgatgaagctatgtgtttttaagaacacatttgatcaaaatcatggaatatgaaagtttaaccgcatacttaaatagctataatttatttgtataaaaaagacaactaggtttgtctcataacataaaaaggtattttccaataaatttatagtagcatctaatttcatataaagttataacacgagcttcttgatcatttgtcacaatttgaagggaaatgaaaatgagatttgtatcctgagtttaattatataataactatttttctacatactatacaaggagaaaaaaattatttggcaacaatttatcgttgttggaaatgcccagtttcgtttttgtctatttggaaatgcctttttaagtaattaaaaataatgaaaagaatatagataattcatttaaaaaagtttacgatagattcctaccatgcccatgttcacacctgaaacaatattgaattgaacatttcattgctggctgcatgaccaaaataataataatttaattggtgaactttgagggcttgacttgtgcttcgcggctgttcatggcttgcatgccactagcttgcttaaagatacacaatttataaacttaaatacaattctgtaattatttttaataaattattttatttcggaaatttaaataataaatatgttcatcaaaaactaatataaattactgaaataaacctttaattttaattaaaaatatttatgaaattgtatctaaatttcgtcttatcagtatttatgcttcaatatattgttctacaatttttgactcattgtttttttcagaaaatatctggtaattttactgtatatgcacccaaaaaagtcgcactacttggtacttgcttttcaggtataaaataatatattgaatagaaccttgagaagaaatcattgaatatattttttatctaaaccataaatatcttttattatagacaacaatgcttgagttagaaaaaatccttaattatagtaaagtgaaataaataacgtaattcatatcataaggtaatatttttatacttttcctttaataatagtgggcttgcttttttttattagaacacaactattttatacaaaatataatttcactcgagttaaatttaatattattgtgatttgaatgattttttactggggcaaaatttaattgatgacaaaattatttgtctaaagattaaactcaattatatatttaaatttaaactcgaaatgatctattaaattaaaaccatcctggctaataaaaatagtgttataaaagtcctatgaaagttaacctacgtccgtgagttactgtggatcagctggtttttgagtacgattcttttagataaataaattaaaaaaaaaaacattattggttcattcccattatttataaaacatatttgttgggatggcaaaaacaagtagagccgcgccagtcgaagtctaagcgtcggctcgaatgtgatcccgtaacgtaagacacctttaacttgaagtccgttagagtcaaaggggcccacacttgccacctaggaaaacctacgtggcactacttaggtttgacctttcccattttctcatttaattttttcattacctatctctctctatatattggtaatatcatatcacccacttagctattactttccatcattgcaattcgcaaagccacacaaaacaaaatgggcaattgcttgaggcgcgaatcgcggattggatactccaccgacgatgacgaggacgaggactgggaggattttccggcggcggagagcggcggtgttaagaaaaggaggagagaggtgaagataaagataacgaagaagcagttggaggagttggttggcaaagtggaggtgaaggagttgagaatggaacaggttttggcgcacttgatgatcaatcactctcttcaacgtccatggaggcctgctcttcaaagcattccagaagatcattaacgtaattaattagatattggagcagtgtattgggcctattaattggctcaatccttccatcataaactagggttttgtttttgttctgtgcttctaggggaatgttaatattgtaaccagggtgggtggttggatgggtgcttacactttttttctttcttttgtaaatacaaaactttagtacccttttgatgctataccctacatatatcactattagaggttgatttatctttatctattatcttctttttacttttctcgtccttctcatatttctatttatattactaaagtgatacaaaattatttcatctagtttattaatttttgagaaatagacttttgctatctgaatattggtggttttacttaattagatcatgctttgactttaatgaaagatatatgtgaattataaaaataatttcaattaaattgtttaattgtttgtttgtctttctaatatgtgttactttcaagagataataatccacaataaaacaatatatttttctaataagaattcgaattttgatttacttattgtgaagaatgattcttttgctagaccgaactccattggtatgttctgttcatgactgtatatagggatataaatttttgtgtggggttgagaaatgtgatgagattctgtaacatgtttttctatctgctccaccatacatattgtgtccagggtggccaccactttcattcttcaacttgagtggcgagtggcgtgaatgaatggttgtgagattcgctttcacaatttgttattagttttttagtctctataatagcagcattgaagttgacgagaaaaggagagttgttttttttaaggcttggtaagatcttcgaaaaggatgaaaaaatcacaaatattttttttatatttctgattgatggctaatcgacttggactatgtttaccatttttttctcctaaaagctgactcattatttttttacatattgtatgaagtaacgttaaacggtggattaattagggcccgcgagtaatttttattaaaacaaaaatggatatttttttcaacaaacaatgggaagctatcactttcaagatacgttgcctaatattacccacatatggttcatctttgaattagtaaaacattatgacaatggatggcagtgctgtgaatagtacatgtatgggaattaaaacatggtagattaattgaatggggtgaagagaagcagtgcattggcaattttgaaatgagttgcactattaatttatcatacatgtcccacatgatggaaaaaaagattgatttggaaattggatctgaaagttggaccaagtacaagtcatggacccaacaccatgagattaaactgtgcaaatgctctagcctacaactaaggtttgtatcctttaatgctaagcttggagtagtaggtatgatgcctattcagcattacacactttctatatatttttctaaaatatggtgtaaaaccttccaaaattcctagggcaactaaatctctttgtcgtcactatcgaaatttggtggttgatcaatcatgaattaatgagagctttgtggatagaataacatctcaagttttgagttcacactgctcctatttcctaagtcctaccacaaatgtttgtattctagtctgccggcagtacttccaagtccaaacccaaaatattataacaacaaattactattcctcaattttaacataagtatcattttaagattatgtacaaaaatttaaaagtaattaaacactctttaattttaaaaataatttactcggattatattaccttttcattttataatattgtcttattttgcttaattaatagtatataaaaactacatatgatttaaagtattttttttaaaatgaattatttgctctctttttttaaagaatgacgaatgatttaaaataatttaaaactttgtgttggttatttgatataaaaagctccaaatgtcatatctgaaaaaattttaacaaaaaaatctacactgcaaagatacttttatccaattcagtcaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtttaaatttatgtcacatgttcaataaaaatgattttttaaggtgactatggcattttggtgtaacgataaaaatgtgattgaattaattttagtaattttattttataataaaatatcaaaaagatttatcctccctctcacgagtatcgctaaataacttctgcagaagtacttatatggctatatttgaataatgcttttatatacgttcactatagtaattttcgattacaactattgacaattaataaattttgtattgaaacttattggatgtttatttatttaatgataaataatataccgatcaaaagaaattccataaggtattaaatatttttttgtagtgcaatatattttttcattggttcgtatgacgttcatatgccatatagattgcctcatcatctttaaaagaacaccctgtatacgcacacgcacacaatacgtcacccactcgatctcaatgcttacaagatgaaaatctttctattggtaagtggtaacactaacaactacaatgatattagtatagtattgtaaacgagtaatgttcacttgacatgatataccatatcaatatcaccatcttgtaattgcttttcaaaataaaattgacttcccatcatcgtcacccatgaatattatattgatatatgttgcatttatcttcttgtattataaacgactgataggagtatatattcactgcaatttgcgaatggattatatcattattttattacaagaaaaatatcgacagatgtgtgtatataattaaaaaaaaattcaaaattgaaacgtggttaaaaatttaaagtaataacactgacacaatgtgataatgannnnnnnnnntgtgtgggaaaagagtaaagagaaaaagtcatgatgggatttcaaggattaagtggtgctattgaaaggagaaaaccaaagttttcatcagagttatggaggaagaatgttaggaaacacaaggaaatgcaaatgatatgtgagcgaagatgggataaagggttggaaaaatagctaaaagacacttgaagaatcaagaggttggggacctgaggataaaacatcttggtgatgatggaatgtaagtgtataagataaagttaagattaaaatgaattgttttaaagcatgattcttgtgttagaatgctgaaaactagaaaatgtgtgatagttaagaaaagtaccaaaaaggaactgaagcaagaactaaaagcttttattcgattatgccaagccttagggatcaaaagtggagctagagctgctacactctacaggcttgctaaaattagagagaaaaagtcaagagatttggataaaaaaagaagtgcattaaggatgaagacaataaaatctttgtttttgttatggaacaaaagtacaagacacgatagaaagacagaaaaattacttttagaagttatttaattaagtacgtaaatttctatcaggttaaacacaagggacgaggaccaaaattatgccgtttattgtaagatttgggagaaaggtatcagttggcacatttctataaaaaaaaaaaaaaaataggttatgagtatgaggcccaagaaaatgccagaagagtgaagcagtgatactctaacaccaaattgttagaatattgatatgaaaaagattatgcaaattattggcgataaagatgaagttatgagaaaaaggttattgagggaagattaagaaaaaagactcatattactaaaacaatttagatttatgcctaggaggtaaactatggaagcaatataattgctatagcatttaatgaggagatatcgttggaataaaaatgattttcatatgttctttattgagttagaaaagacatatgatcaaatactaagaaagatattgtggagggccataaagaagaaagaaatttgtgttgcacatcttcaaacaatcaatgatatatatgaggaagtcaagactagggtgagaacacaattacacagtggaatcacaacaaaatttcttataaccataggattgggccaagggttaattttgagctcttatctctaccttagtcttaaatgtccttataaagtgtatccgaaagtcaatacaataatatatgctttttacatatgtagttctgttggaaaatccatagatgacataaatgaaaaattgagtatcttagatattcttttcttatataaataaaatgaactcacaacttaatttttcactgtttttattaataacaatacctattttctcccaacataaatcaacatttgaaattcatgattaacaataagcttgacggctagaacaagtatttgtaaatttgtttcgagagtcgttatatactatcgttaaaagggatatttatatatagtatcaaaagcattcaacactggccaaggttaaaatagtggcgttttatgtagttattggactaaaaattataaaaggaaaataagtgaaatacattaggtaaaaatctttaccaggaagagaatataaaaataaaaataaaaaatgactactaattagtttcttgatctagtctgccactagaggtgagtttcttataatcagtcattatggaacgaaatcaaggaactaatattacaacccaagttgccacaacaattctcatgcagaaattattcagttttattgctgcaacaaagcaactacctttcatcaatgatgttcattcaaatccacggagattacacatgaacttggtatctcattcaaatcaacagagagcatcatctatactcttggaagttaacatgaccagttgcttgtgcatgctccactgcctcctgaaatgttcacaaaaaaaaaaaaaaagtactcagaatcattagaacaaaggagaataagctaaggtgggtaaatagaataaagcaaagcatcaggtactgagggatcaccttctgaccaattactccaatttggcatactccacagcgcagagtgaagttagaagtgtccgtgtaactccgtttcctgagaaagtgtagccatgatatattagcatcatgggcatagcataaataaataatgatactaagtagcagaaataattgggagaggccattcgagatgataaaaaaaaaaaactacgtaccccattgccctaaggctccacgctatgcgcagatagatgatatcgaaattaaattgagaagattaaaaaaaattacatcatgcaagataaaacaaactgacttccctttgtattattgcagagttaaaatatacgttcctactggcacacaagatacatagcccaactatctctttcacttaaaaaatgtgcataatttcacctgtattgtttgacaatagaaattggcaaagttgaagttttcaacttatcagtctatgtatatatattaacagctttgcggcacattcaccatgttcttgttctaaattgataaaaggtgcactggatttgcaaaaatgtcttcttctgtttgcaccaacaattacaaaaatgtcattagtttcactttattttttgtttttaaatatttgcacataaaaacatgaattgaggtgaattttgtaattgttactgaaaacagaaaatatttccacaatccaattccaaattcaaatgcatcccaactcctctgaaagtgaaaccttaaaatacatgcccaaaaagaagaccttttaggtaccaatattcacaacaaatctgatatataaagaatccaaatatgaagatttatgtaattcaattatctaaatatgataatatttatctctttcttttaagaaggttcaataagaatagcgaactacctctgctggtccttcacaaaatttagaacaagcccttcaacaggtccaatgcttctgtttttctgtacagcaaatatggtctgatcaaactcctcaggagcttcctcaaagggagacatctgacccatacaaggggtgtgagtaatcatcaggcaacatgaaaacaaaaatacatatgaaccttaactttttaattttttttattgtttcatgtgtagtagataaatatagataccatatacttgtaatctcacaattcacctccaaaaccacaaaaaaaaatgcacagaagagaaggaatggatcaacatcaacatcaacaatacctttaacccaagctaattggggtcggtgaagagaaggaatggatgataaaaaaaaaaaaatccagtatacgaaattacttaccactaatgcatcatagtggagaccatcataaatcagcatcactctttcagaataattcctttcctgtaaaaagtattcacaaaaagtgaaaatagaaaagttcagtcataagaggttgcaaaacttgagagcatatagattgcataagagtgactaacctgaccgtacaaatcacatcgagttgtctggatatcatatgctgcaatttcacgtccataataatctgctaatattgaaagttcaattgcaccttcacaaagaaaaatagagcttaattagcacatcaaactaacaaaaagttaacagtgctttattgttaaatttgctagtaggagtttgaaataccctttgaaacccatgtcaaattcatcaactacaaaatctatacccaccaaatttatatcaaaagcctaattttagaaacaaaactgaaatttaaacaattgtcacagaagattctctgggtatccagatgtttaaataaaatttcccaaattttaattaaatctttatgcctctctgcgtttcaggaaaataatatattttactcatatatactccataatatatttatcttagcaaagtttattaaaagctcagatgttaaatcaacctatctttgagtgagtttcatcaccttcaaagttccaaataaaaatgaattttccacacttgaggttacacattcatacactcaccacagtaacaccaaaagtagcagttccaatttgtagagtgaaaattggtaactatttccatctacctttttatttaaaatagccttgattacgaaaaacataggtcaactaacctccccacttctccgagtcaagaatccagttacaatactctgtgtttggcttcccaagaaatgcttcacaatatttctgtggatcacttgctactgttgctgctataacctttagcatgtcaaatgacaaatagcacacaaatattaagtcaaaatatgtaagaaataatgaaataacatactcaaaatgcaaagatattaggcaatacaatggtataaaagttccacttgactggtaattcttaaatgataagcgtcatggcgtggcggattttttgccaaccaccataggcaattcgtgaagagaggcccactgtggcgtgtttacatggaggaattttacccttccgccatgttctaccaaccgccattgataacactactacgatatgtttcactagtccaaatcttgagtttattgtgtttgatacctcaagtttgaaaaatgatatttttctagtagaaaagatcatatatttaactttgaaatttttgttaaaatgtaggggctaaaaacatattaatctctatattttgtgggattaaaactgaatctcgatatattttgagggaccaaaaacatgttttactccaaaaataaaaacatatcttgaggcaaaagttgaccagccagaaatgaagcaccccttggcactagaagcaaattcacaaataaactgaatacaagaaaaaaaattacctgtctcaactcagcagctttctttttgtcatgatccataacatatctgaaacaattaaacaaaaccaaaaggaaggagaaagaacatcacaagtggaataatttgtacaagtagcagtaattccaaaaaaaaaagggcctgtgttccattgcttagcttacccaacagcattgaaaaggcaactgttatccgaaggaatgacccttctcagaataacaccttccatgatgcagattgtagatgacttaccaacctaaaaatcaatcacagaagaaccatattcaaaatctaaaacacaataactaaagcaacaccgcatgtgtattctgaaaagaaagggaagaaagagaaaagggtttgaattggaaaatggagatctatgctatgagaattgaaaaagggattggtctgagaagaaggagagaatgaatacgaaccaagcttgttaggtgtgttggatttggtattggtatttgaataagaaacgttttcctttcctttttatgcgtcaaaagaattaacattaacttaacgggattgctaccgttttcgttcagatgccaccgtcattttcttcgccatgccccactactctcttccatgcccaacacctagcattcgcaacatcttccctattttattctctgttatccaaaactattatttttctaaacaattttattgctatattcaccatttttttctcatgattattttctcccgtctggggaaaattgtcatgtttagtggtcccaaatataattaatttcacattatttaattgattcttgatatttaattttaataaaaagtattttagaaagaaaaaagtaaaatcgctgcaattgtttgtaactaatttttaattatcgataatcaattattttttaatatatttaagatagggggaataatctttattgaaaaaactgacttgcttagttatagtaatataccccgtaaaaaaaagatatagtaatatctcttcttccgatcaaatatgatattttcattcacaacatttattatatttgtaacttaaatgaatatacaaattttgcaaagtattttaaataaaagtaattttcatgtaaataattgaaagaaagataaaaaaaaattaaaattattaaatatgtggatcaaactgatgtgagattatttcaatttaattaaaggttttggattcaaatattgagcattggatagaatatgattatctctaaaggagaataattgtgattaaaaaaaagaactaaaagaaagttatctcaaataatttatttttgcataaataataaataatgactcaaagatgaagaaaatttaattccaaagtttacaatcaaatcctaagaatttatattaataataaaataattaattgaatatttagagtaagattatattaagaatttatattaatttacaatcaaatcctaagaatttatattaattgaattaaaagaaagttatctcaaataattaatttatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgaattggaaaaacaagttactaacggatactaatcaaggatcaggatcttctagagtataccttctcattttagggagagaagtgggtttatctctgtcgtttaattaataaacaatctttactaaatgtatattggttactttttctgttacttatatttatgaattggtcaatccatttcagtgacttatatagtacctcaaaaggaattcatatctaaccatcagccaaatgatatctttagttaaagaacaaaatatgaagaaaaagaagataatcagtacgtactataaggttttcaatgtaacgtccacaaatcaatctaaagaaaatagatgtgagttcgagtaaaagatatttattaaaaatgatcttattcatggtctgtcttatgtaatacgatgtcacagaagctgcaaacaagaaaaatccaatgactaagtttatttcactttaaataggtgcataatctttgagagagaatccgaagattagagacctcgctaggatggtaaatgtaatcacaagagcaccattatccaaagaacaaaactaagtaaaacttcaatactaagatatgtcccttcctgcattattaacctgagtttgctgatggagccagatgtactagtacaattgatgcttatagagttgctatgcactcaatttcaatcttggcatccaatggcaatgcggctacttgataagttgaacgagcagggaaaggtgaagggaagtctgaaatcattggaaaagtaggtaaattaaaattatttaagtaactgtaggcattagtgaaaattaaataataccaacccaaagggaaaaccttaatattttcagcatggtactagtggactctctagtatcaatctagaaatcacccttagtatatattaaatatgacaagttgacaacataacctattacctattatgacaagctaacaggtgaatcttcaagactaaaccataaaaaagcatgaaggttttgaatctaaaagctggtcagtggtcagccatggtacatgtatgttacctacaggctaacacattctcagcccacaaatgcagcaggatcaatttttacagcacagtacaaattattatcagaagtgaaattctttagtaattagcacagttaagcagtttgtcaatacaggactttcatgatctgcaatatgaaatcgattcacacctaaacaagttagtgcaagcttcgccttctacaagaatgtaactgtcaaggaaacattaaaaattaaaatcactaccacagaactcacatttagcatagatctcattaactttcttgaagtccttcaagtcagccaacctgcaggaaataaaaactcaaaaactagtaatcttgctgaaacgccataaaccccaaccacaaatgagtgaggaattcatacataattgtcgtcttaacgaccgacgagtagctagcaccaccggctttaagaatttcccccatgtttttaagaagctacaaagggtaattatatcaaatgtcagcaacaaaatcaacaagtgcattgcaacatcaataaaatgttaccatcatacaatacaacaattgacattcaaagaatgtaatatcacaagataaaatgttgtctcattctgtacctgttcagtttggtcttcaacatcatcagatacgaacttcccgctctgcattgaagagcaaaacacacatcaacaatctgaagaaacgaacatcataaattaaaggaagtgataacaattaactgaattaaaaaaacctcgggaacaaggccaagaacaccagacacaaaaagaaggttgttggatttgattgcttgagaatatggtcccagagccgcaggtgccccttcggtttgaacactttccttaatacctacaaacaataaggttcaccattataataaaaaagtaaaagtttaaaatttgaaggtttcttcataatgggtacttacgagtttcggaagaaatgctcaagcatgtgaatggcaaagagtgcttcggtgacgaagaggagggccagaaggaggtgccgaccaccgacaaacaccctactccggcggccaatgaagcacggttgagcagtgcgcggccttccatcgccggaatctggaagctccgagcaccgcaccacgacgccatttctatatctctgactgactctaccttacactctcactctgtcaaagtcttcaaccttggactttgtttttggggtctttgctgcaatagtcacttctttttaccaaaactacccttatctcaggcactcatttaccattttggtcccttaaaatggatgggctccaagggttcatgggctgggcccatccttcatcctaataacagttttggttgggcccatgttatttacatacatcttttctctaagttcgcaccttttttttttttgttttcaaaaagactataggcaattgttaaacatatctcccataaatattagatatacctcttttttttttattaaatttacttaaatatccacatctcttatctctcaatcctttctccttcaagcctttctattttataatacataattgagaaaggtttaaaaaaaaggaatgtgaagtaaggtgaagatatttaataaatttaataacaaaaaataaaacaatgttgtacataatgttgagtcatgcaataatttatatatatggtttggattaataaaacagttgtgtgtgaaactgaatcaaagcatacagagaaaaggatgagtagcataatcattgttgtggaccaaaaaatgaaggagaaggaaagatatatggaatcagtcaaccatgacatgaaaaataaagaaaaaagacatgaaacctttgatttagctaaattggtcttcatattaaaatttgactctgaatctgatgatgacaaggatgatgagccatattcaccaaatcaagaccagaaagagacccaattacaaaacaattaagaaaatgaaatcatcaactatccaagttaatggcattagcttcttgagtgttctgtagttaggtttattcttaatcttggtttgacaacatgactcatcatacttgtcattatcttattcagagtcaaattctaatttgaagaccaatttagctaaatcaaaggattcttatctttttcctttgttttttatgtcatggttggctgattcaatatggctttccttctccttcctttttggtccaaagcaatgattttgccactcatcctcctcttcgtatgctcttattcattttcatacacaattattttattaatccaaaccatatatataaactaagacataacttaacactatatatggcattatcatacaatgtatatctagcattagatttaaaagacatgtttttttagctttatttacatatgtaatttaaatatcaatatttattcttttatcctcatataaaaatcttttcactaaatacgctcttagattacacacatagttacactactacatctcccttattatgtcggttatttggggttttctatatcgctagtatgaatcagccaatgtaaaatgttagaatttttcaaattaattatcttagaatggatgtaatttttttttacataatttctaaatagaatcgatgtaatacgtgccaatttccaaaacaaaaatctctcacaccagaaatctaaaccaaagcacaaaacaaacaacaactcttaaaaaaagtcccaaattgaatcaacacaaaaaacctattgaagccaaaacacaacaaaaatcaatcaatcagtcaaaaataatatattacttaaatgaaaaagacaagacatggaaaaaagggaaattcatagtacacaattgagtatcaaaatagtgttacctccatggagaattgcacgatgaaattgccaaatctatgtgtgatggaagggaaccctagtgggtgcatggaagatggagtgagggagagacaagtctagatccactctaccactaaggtatcgaccatcgttcggaataattgttccatctcgtgttgcaacaatcactcaatcaatagaaaaacaaacaatgctccaaaaaaatactaattaaatcaacacaaaaggatttgttgaagccaaaacacaacaaaagtcaaacaattaccgtgtggaacaaaaaatggaaattttgtacacaattaagttatcaaaatgatgttacctccattgagaattacgtgacaaagttgcaaaatcaagatgtgatggaaggaaaccctagcaagtgtgaaggagaggcatcctgagatccacacctccatcaaggcaccaactactgcccataactgtcattccattttatgtcacaacatgcataagatcaatgcaaaaacaaacaattctccaaaaatcccaatcaaatcaacacaaaaaagtatccgccaaagtaaaaacacccaaaaaatataaataaaacaatcactcaaaagcaatagattacctaaatgaaaaatactatacatggaataaaagatggggaatttaaagtatatagttgagttatcaaaatagtgttacctcaatatataattgctcgatgaagtgttgaagtcaaaaagtgagatccagatccagattgccactgaagcaacaactgtcacccacaatcgctgctctatctggtgtagtagccaatgctgttagaatcacaatccagattgtaggaacgtgcgactcaacgatttttgaagacatctatgtgttgcatcgtcgttaggatcgttggagtgcaagatcagattaaatttgcactttttcatgtgggatatgcaatcctatctaaacaatttaggtgagcaaataaaggtattttgcgagctttgtggagactctttcgtgtcgtcgttgttgtgttgttgccaaacaacctctgttcttacagtcgctaacctcctagtactcttctatctacgctctctgtttaccataaggaattagggttgcacttgttcttggactttcacaacaatggctgatgatacttagcatttataggagaaacatgtgggtcttagggtttcaagggaattgggccaattttttttctttattttatttttcatatttgatttgttgggccttaattaaagtccaatttagtttttttaaaatgtaaaatattacatataatataataaataaagaagaagaataagaagaaatataatagtattataagtgtaattaacaaaaaataaaacataacaaagaatataataatatgataaactaaaaaacataatatatgatataacaaattaaagaaaaatagaaataaaagttatatattatttataagtattttaggcaaggaaagtaggattttatgatccaaatcacatttttccctactcgatcctaggtaagatcttgatttcaacaaccatgataacaacaaacaccaaatcgaaggataaagtgtaaaaggttttaatcgagtaacactatagacactaaatctaaaataactctccatgtaaaatcaaggttgtggtgaatatgcatcaaaatccaactttgctctgcacaagagcaaggttgtaacaaggatgagttgaggtgaggtaaagacgcattaaggttaggtgagatccaaccaatggcttcgggtatcgtcttcatgtggcagagaaagggttaaggcaagagggagaaaggagtgtcatcctcaaaaaagagatccaatcatttcaaaattgctctatcaattttgaaacctcaaagaataaacattattatatagagcaaacaactcttacaatattgtgggcaaagtgggtttagaacgtaataatcaatggattattatatagagcggacaactcctataatattatggtcacagtgattttagaatgtaaaaatcaatgagtatttataatatgataagttggaggttggttacaaccatgagtgatagatatgattaacttatacaataaaatcaactttattgtttggggagggttcatataacatactaattgagaagtcattcaacttaatcttataactttgtcaaatagacattctctaatattttcaaagaatctgatatattgttcaataaagtatttaatttattgacgttgaacaaataaaaaacaatttaaaaaattgctataaaagcatagaaatataaagtaaataataggaccctagtgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttctctttacttatttttttatatctttcactagatttttcttttatacatttatctttcactagatgtatacacccaataaatttattatgataatttttctcatgatttggttaatttatattgttatttttaataaaataattacttctgggagtacaaaataatgatagagagaaaaaacaattatggattcaaatttctctcaataataaaaattaacaaactaacaattaatatcaattaatatttgttaaaaaataaacactaaccttcaatcaataatggcaattttcttggaagttatcaaaatagaatagcatgtgaaatgctaaatagtcaacttatggcatgttagttagcaaaaagatttgtatatgacgagggaggaaatagcactctcccttaattggtatcacttttaacagactcacttcagccacaaatttgctcccattacatagggtagattcatgggccatagctctacaaagacattgcagccttggtcttttgcttgcctttataaacataataattaacataagtatgtttttgttaacattttttttattttataattttgtcgatttaaaaaagaatactaagattttgtttttttccccctaattaaagaaaccccaaacatgtacataacgacactcaactcactcaagtattcatccaaccaaaactataacacaacaaaataaaatcagcatctccacaaaataaaggttgctttagcaactcaactagccaagcgggctaggaaagttaattgtgacttgaaagctaagttcttttgtagcttcaaaaacttaaacatagctttattattgtcacagaagaattaagaaaagcaaaaccactttgtaaataattaacccaaaaatgaggaggccgggaggggaaagaaagggcatacccttttcctttacccaaaaagatatgtgaaagtaaattcatctttagtatccaaaaaaacgtgctccattttttaaggctttatgtgatcaggtccatggtttgtgtatcatcatctttagcatcggacaattatagttctttgtgtgtatttctcttttacctcaataagtattcatctaacaaataacttaatttacaattatcaatacaaaaattaatcctacaaaaaggagaaaaaaattaataaagaataacattttgttttacaaaatcatcttacattttcataaatataaaggtgagaatgtttattccaatatttaataagaaattatcagaaaatattcatgaatatcttttattcccaaaaactgtaaagctgggcacaaaataaaataatagtgtttgagattctctattgaattacaagctaaagaataaactacaaagttagcttcttttttttctcaagaaagttacattcctatgcctacaacttttcttcccattctaatgggatgagaaagttccaaattgacttttatttatcatttattaattaaaagaaatcaatcacactccaataaaaaatctcaatatcatattcgtttataaaaaaaacaaaaattaccttaaatattattagaaatgttaaaagctaaccaaacatattttattatttttatatatgcttaggaataacattcctcactacaaatttataggaacgtaatttctaaaaatacaagataattccataaaaaaataccctaagtatcatttacaaagaaaaacttgaaaactaaatattttcataatgttgtatactgacaaataattctttttttttctgttaaaataataattacttcaaaattaagaaatgtcaagttaacacggtcaatgtaatagttagatttaaagtcccaataaattgttatttagagctatgacttaattaatttagtgcataaaaattaaaagttaataaaatcatttattaaggatgtctagttcaattaattgagtaagatttatgagttatgataaatcttttaatattaccttctattattgtggataaaaaaaacattttacagttttaaaattataaagtaggatttttatttgaagtgttccttaaggttttgtttgggagaagaattttggaggggaaggaagggaagagaaaggtttaggtagagagatttccttgtttgggagttttaatttttgaggaaaaaaatttaaggatttttaaaactcctctgaaatcctccaaagcttaaaaatggttgtcctccctatttgggggtttttagaaggaaaagtaataaaattactatcctacctcaaccagtgttaataaaattattattctaccccagccagtgttaataaaataccaaaatacaaagcactaaatcacaattcaagggcaaaattataaaagtacttattttattaactttctatttctctcttaatatatttttaactcccaaacaaggaggaagaaacttccctcattttcctccctttctttcccctcccttctccttgaatctctctccttccctccccctcctaactcccaaacaaagcctaaaacaacgcatattgtgtatattttccttccatttcttatcattttagcatgaaaatattttttagtgtggcgcgcctaccattttttaatttctctccttgttaattaaacttaatcaaataattcaactttttaattttccttctaatttcatctctcttgccagattttttttacctatttcacttctattaaataaaatgagagcatctaaatattaaattaagattttagataacttttttgtggatctcatagtgtcacaaaaatctctatttttttagtggtagatcttattttgagatcttaggaagagaaaaagaaaaaaaaaatattcttttttgaataatatgcaaatcttaaaagttattttacaaaaaccaatttttcatgttgaaaatctcttcacattttttattaaaaaatttaataaaaatgagatattaagtttaaaatatttgttcaaaatctaacactactcctcaagtgtttctaataaagcaaaaatgcgagaattattttaattgaaacatagaatctgttgggggtatgagaatttgaccagaaagtgtatgatttgaatgaaataaaaaccgtgaatgagttgcttgctcgtgtacacgttttcttgcttcagagttaactactacgaaaatgataataattatatgttgtctcgtgtccacgcttcatgatttacatttcacatgtgtcctatttcatttgatgatcacatttttccaatttccatcatatcaacgtcatcaagcacattatttttctcttttagttacgagtagatttcttttatttgtgattagcatattcggcgaaggagaaaaaatgaataaaaaagaaaagtaaagaaattcattaatattatttgatttaaaaaaacaaacatattttttcttcataaatattataaaaataaaatgcattgcaaggattatttttgaatttttccccctattcttccatcacatttcctcttatgggagggaaaaaattaaagcaagattcacacttttttttttctttgttttcttcttatgtcaaacagaaaaaattacctcttattgatactgtatcttagaatataagatatccatcaaaatatttacattaagggtctgtttgagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaagctatacgcatgaaaactaacaagataaactctatttaaacctaaagttatgacgagtgtttctatcctttatggtttttgttttgttttcttattacttctcattttattacttgttaattatgttgttttaattgattgacaatttaaatgaaaataaaagagttaaatataattttggttatccaaaaattcattgaatttggttttagttcttgattttttttttttaaaataggtgaattcagtctctcatcccaactttattaatattttgctggcatgactaataactatcatatggatatcatatgtttgccatgtgacattaaaaacctttttttttaaatcaaactaaatctaattttgatcaaatatttaaagatgaaaatcacaattttaaaatgcatttaaggttaattttgactaaaatttcaggaaccaacacattttataacaataataataatttctcggcacacttgtcatttttttaatattgagaaaatgctctacaaccaaaacaaatttttagtatgtgagaattatttttatcggaaaataaaataaaacatttacaaataaatgtaacgtctaaattattagaataatgtctcacactttatcgaaggaagcataattttttcattgaagaccccagtgtggcatgctgatcctgagttcttacgcaggattcaattttaggaattgttgatttctacttacaggtgtaaggtaatttaattttagaagattttcaacttcaaaagaattaagtgtattgcacacatttccttttttggttaaattaaggatcatttaagtcaacctttatatagtagaggcacatgaaaatataatattgtattaaattaataattaatgatttccaataatgtaattgccaaaataaagagatatgaacaatattatttatgattatatatttttatgatctataaggaatctattatgctatttatgaaaattataaaatttgattttgaatccatagaattgtgcacatactaagatacacacatagtacctccatagagttttttatttattctgacctccacagctatttaatgatttggttaatttacaaatatatttttcaacattcttttattaatggttcttttctcttgacacaatgatcttaagtgcgaagcttatactatctcagataaattttttcattacgcgtattggaaatgcaaaagtctatccaaatacgaacatgagagcagcatcaccttagtccttgaacaacataaaaaatacaaaaacaaaaccttagactaaataatttttttttggttactcattaacaaaaattaggtggcaccatgtggtgaacgaatcaggagaaaaatgtggtgttggatacgcaactctgattcggtccttgaatcataataaagaatgaatcaaggaagtttttcttctattatatggactccctccaaggctctaaccttgttttggtcgtaaaatagtttccacccttttttagttaactcgttaaaatccaaatcccacagttgactcggttctatctttatcctttttgttgagactctttctttctactttcctctcctcctttaaaaaaccacatattctgatccattctgcatcaacctttggcttctcctcccccccttttctctctcttcacacttcaatggatattctttcttgaattctcatctgggttcattccctttttcattctttgactgaatcttcacactttcaagtagttggttgtgtggtggtacctgataaaacttaaaaaatctcttcccttttggtgtcagaaccatgggttgttgtctgagtaaaaaagggtcagagccagcagaacacattggttacagacatgttgccggtgctgggggtgctggtgtgtacaacaatcacaagagccatgaaccctttgccacccaaaccaaacccccttctcaccaaccataccaattacatgagaaacatgctcctcctcaggcaccttggaggcctccaccaagcccaaaacatgttcacaagcatgacacaatcactgggaagccatttgaggatgttaagcagcactacacacttgggaaggaattggggagaggccaatttggggttacttatctctgcactgagaattcaactggcctgcagtatgcctgcaagtccatttcaaggaggaagcttgtgagcagagctgacaaggaggacatgaagagggagattcaaatcatgcagcatttgagtggacagtccaacattgtggagttcaaaggtgcttttgaggataaacaatcagttcatgtggttatggagctgtgtgctggaggtgaactttttgacaggattattgccaagggccactacagtgaaagggctgctgcttcaatatgtagacagattgttaaggttgttaacacctgccattttatgggtgtcattcatagggatctcaagccagagaatttcttgctatccagtaaggatgacaagggacatctcaaggccacagattttggcttgtcagtcttcattgaagaaggtatattttgttatccatgcattggtcttttcttatgaatttttaataattgtggggattcctgaaaggtaagtatgtgaactgtagcatagttgtgaataatcttctaaagtttttgaggaaaattttgtataatttccatccaatttttttttttttttttgtgtgtgtgcgtgtggggaattggatgcaaaaggcatgtaagattgaaaatgatttttctattaagttctaatagtgcattgccaatgcttgacatcaatggcctgattgtcaagacttgcaaagtttgagtagcttttaatttgtttcatgggatttttttttctctccctcaagatgtttatttgaataaacttctgccaactaatttttctaaagctttatctccttttccttttttctccatatctatgcgtgcactttatcacatttcagtagatggacatctttgccactcaatttgtgccatgatttatgaattaatttttttgcaagtatggagatggaaattgtaaagtgatggcttgttagaaagggtttatctactgttaatttaaagtaaattaagtttacgaagttgacggttgataaacctcgcttacttattttatacatcatctcacttgtataaaacatactaagttttttctattaaatctttattcttcacaggaaaggtgtatcgagatatagttggcagtgcttactatgttgctccagaagttctacgtcgtagctatgggaaggaagcagatatatggagtgccggagttatattgtatatcttacttagcggcgtaccaccattttgggcaggtaaactctgagtttgatatgttgataataggataatttccttgtattagaggctagcttccccctgttttacagttgactatttttttaataaaatatgtgatgtagagacggaaaagggaatatttgatgccatattgcaaggtcatattgattttgaaagtaatccatggccaagcatatcaaacagtgctaaagaccttgttcgcaaaatgcttataaaggatccaaagaaacgcattactgctgctcaggttctaggtaggtgacttttattgtgttttctcctcattgatagtttgaatttctttcccacttgatccttttacgtgtgtacttgggtgaggttgagaagatagatcactagaggggcttagatgtattccagttctgttagcaacccaacgattgattttatttattgaatgaaaacgaatcgaaacatggattctcctctaaggattccccctttcttacaagcttgttaactctctgaatgaatcctttcacagtttcaccctttcaccatatttatctaattgatcccctccaactaattactctagttcccaactaattttcccttcacttctatctaacacataacaaggctagtggatatagttattactaatagtagtgttgcatataaaaactgaatttagggcttaaaaacttatacgtgccaagttctttccatctgtatagattattctatacccatataggtgtgacaacgacaaccaatgttgcatttgaacatgttagttgctgagactagggacttttcagagacaatattttcacaaatatactgtttcttctattatctatcctttaaacatgtcagttgtttagttacaggacattctgtatgtgatagaaaatgaaacattattgaacacaagggaagctagtaacagtgtgtgtctttgtcttgatgcagtgactcaaaactgtttcccattaatattactgctgactgatagcttgattgcaccatccttaagaattttttggttcatgaattatattttctctactaattgattccttgtattgtttaaatatttagagcacccatggcttaaagaaggtggaaatgcttctgacaagccaatagacagtgcagtgctttccagaatgaagcaattcagagcaatgaataaactaaaaaaactagccctcaaggttagtcaagccacaagctgcatgaagtgaccacaatgctcttttatgcttattgtatttgatggcataattaaacattgagacacataatttttttttccagtgttctcataatgactttaaattgctcgactgtgtgtaactttagggtgtaggggtgcatatctctacctattcaaaaataaactgagtggacttaaataatcgttttaggtcattgctgaaaatctttctgaagaagagatccaaggtttaaaggcaatgttcacaaatattgacactgacaatagtggtacaatcacctatgaggaactgagggcaggattgcaaagactaggctcaaagcttactgaagctgaagtgcgacagcttatggatgccgtaagctattgttgaattcacaagatttgccctcctttgctttttctatattctttcaagcttacactcctttgcttaaatttaggctgatgtagatggaaatggcacaattgactacatagaattcatcactgctacaatgcatagacacaggttagaaagagatgagcatctttacaaggccttccaatattttgacaaagacggcagcgggtaagtccatctactgtgaattaacatttcttcctcaatctgtcacattatggaagtaattgttttttccttctatgcattctcaacctcaattttgaagtccatgccttccatattaatcttttgactatcggattatgttttcagttttttttgataagtatttaacaagatcatatacataaatcctatttcttcctacacccaaaagcacatacattatagaatcattaaataatgaatagctctatttagaatttaaagagtaatgacacatgcaccctggtttttgtttgattacatcacaggtatatcacaagagatgaactggaagcagccatgaaggagtatggtatgggtgacgaggccacaatcagggaaattatatccgaagttgacgcagacaacgtaagcctgtttttctttttgcttactacaattttgtattctagttctatccatagttgacactcaattttgtggtttctcaggatggtagaatcaactatgaagaattttgtacaatgatgaggagtggaacccaacaacaaggcaagctattctgatgtctctagattgagtgtcctgcagccaagatggggtgcttgcttcaggtaaaggcttccaagagttaatattcatcttaggcatgtaaagattgtagtttagatttgttttgagttacatgctccgcgtgacttgttgtcaactcttatttctctttttggtttccttttcacttggaagtttattattgagtccacatgtaatttattaggcacactaataataaatggacttgcctagggaaggtggttttccaagttagattctacagtttgttaaattgaaatcctcatccggtatcctttcttaagaattgcactttcactgataaaatatttattgggtgccaaaaggcgaaatatttttgttgctggttatgatttctagcccttcgttttcttcttgaagcgatattggttggcctacggtttgtggttagtgccatgtctgatgacaaccacgtggagtcatgctgggttatgtaagggtgattgcagattagatgaattgaaattagttttgaagagaaaaattctgatctaatcttatcagtagttatttactttaccatttaatgtgttgaatttaagtttaaatctaatctaattttaaaatagtttggattgccaaacccaagttagtaacatggttgtcatcaaattcccaccattgcccaatgttttttcatccttgatatggggaatgtagtgaccactattaacagcagttcctttgtgaatagtacaactgacaagttgtatgccaattctaacagaaacagctcagagttcagacaatctatatgtgaatatatcctccaagaagacaccaagaaatacaaaatgcagaaatagaaacaagaaagcagtgctctaataaccctgcatgtgaaaatcagatcaaatgtgccaatgtgagacttaattcctttgaaacttccaaaatacactcaaaacatccaacacaaatttgggtagcttgctgaaaatgtaactatcagtcattaaagtgatagagaagcagaaatttgtaacgttaaatggggtagcacgtgctggtttggatcaccaaaccagtgaggcccactttcaagaaaatgtcggaagtttagtccattagaagtttcaacacaaaaaagccaaggttccttaatccaatgaataattatttttgctaaaccaagtcatcccaaatgagtctagattttatgttgtctttggttgaaagggatgaaaacagagaagatggaaataaaagtagatatttgaattaaagtaaaatgtattaggtatgagattcgcatgtgactcacaatttttctctctctattatgcttcccctttcctcaaccaaacaacaaattttggaatgtccaagtacccacatcttagtatgtgtttagatgagcgttgacaaaattaattttgaatgaaattgttttgacaaaatttatttttggttaaaaataattctaaaactatgtgatttatgattgaaagtttttattataaattaggagtaaaactttatataaaatttgttgatcccatgcaaaagatatcaaaagttgttttaactcaatcaattttgattttagagtcaattcttaactcttatttaatatgaaaaaaatatgtgaaattgatctaaaattaattttaaactcaaccaattctacagtgtattaaataaaaagaggttaataatagatatcatataccaatatgatcaactggcctatttaaagggattgtttgacaaatataatccttaatctatattagcatttagaattgttgattgaatccggttggcaaacaggaacacatatcatgggtttcgatatggagttggtctggtccataactccagtaactgacattgataacatttggagggtcaaccagtagagctcttaaagcaataactcttcacttggtagaactagaaccactacacaaacatatcccaggtaatgactccatatctttaacagcagcccagttacctgttgaagattgaagcagcattgttgcagtcccagtttgtcacaaaagtgaaggctacagactaaccctcacaattgaaaataaagtcctacaaacaataaaaatatttacttatcaatttaatctaatgaatcatatcaataaaaatattttataaagtatattagtaataatatttttttaataagaaaaagtctaatcatgtatacaaacaatattataaaaaaatacataatttaaattataaaagcgaacacataatctaaataaataaattatttcttaaacacgttatgccttgaacaatatgtaatttcaaatttgagaaattttttcttaattttaaaattttatttataattatagtgtgattttaattttaaacttttgataaattgtatcaaactgaatatgtctatctttttaaatactctgaatattaatattacagtaatatttatcaatcttaattaaaattgttatcttaaaattaaaattataaatccaataacaacaaaatcttatgattgattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttataaagtatattagtaataatatttttttataagaaaaagtctaataacgtacaaaaacaatattataaaaaaatacataatttaaattataaaaacgaacacataatttaaataaatcaattatttccaaacaagttatgccttgaacaatatgtaatttcacattgagaaattttttgttaattttaaatttttatttataatttttatttttaaaattattaattgtgattataattatagtgtgattttaattttaaacttttgataaattttatcaaactgaatatgtctatctttttaaatactctgactattaatattacagtaatatttatcaatcttaattaaaattgtattcttaaaattaaaattataaatccaataacaacaaaatcttatgattgattaaaattaacgtgttttatttgttttaaataaagttattatttaaaataaaatactctataactttacatcaccaaaacatattattttgaaatttaaattatattttctaaattcaaattacaatcttgtatatatttcaatttcaatgcaattaaaaaaaatagatagaagattataaaaaaaagaaagaatataaatataattttacttgacaatattacattagagtaaaatttagttgtcttgtcaatatctatatgaacttatctacacaatattatattagatcagattttactatcataattatatattatcttatggtttatctttattaagttttttacacaatctttctgttacagaacagttatatctacatagagtggcaaacggtgctgattatccagttatatctacattagagtggcaaattatctttttacatccgtgtagtgtatatattagagaggtgaaggaggataataggagatcattagaaaaagaaagaaatcttctaatctgcaaaagtgcaacttaagggaatgggtactgcaggtggaaagaaagaattcgggcatggagaagattcatcagcttctattccaatgaagacggtggttcgtgactttcttgcagcaaaagaaaaacacctgcagcatcctgaaatgggtgcgaagatcagtctcgaaagaaaagtcgaaaaagaattagaaaataattataacccatcaaagagagtcaaaagcgaatccgaaggggctagttcttcgcaacatggcaaatcaaagtttgaatatttactagatgcagtggcggccttatttactgaatatgaagaagaacaagattgcctccaagaaagggaagatgctagaaacgaaagaaatgtgggttatgagcaagggccacctgatgaacttgatggattgccaagggaatttcaagaaaagatccaagagttgaatggatgtgaggtgcagtttgtgacgcagaaggaacttttcaaaacagacttgaacccacagcaagctcgcttgtcgatcccaccttcaaagattgccaacacatttctgacaccacctgaggagtcttccttaaacgagcgtcgaggtataaacaggaggctttctggcatgccagtgatggtgttggatccgtctttgaaagagtacaacatgtgcttcaagaagtgggaaatggagagaagctacgtctacaacttgaccaagggatggaaccagattgtgtgtaacaacgatcttaaacttggtgatacactgcatctctggtccttcagactctcctctaagctctgttttgcactagttaagaatcaagttatgaatacatccgcgccaggatcatgatttcaaaatataatcttcaaattagatttagttattttgggagtttatattttgtttaccgtttctgttattcaattttagttattaaactagttttattctaatttttgaaattattcatgttctttatacttattctagtcaataaattattgtaaaggctaaaaatataatgttagaagctgaattcagagttgtaaagtgtgctgcatttagaggtcaagacttattctcaaaatataatttggcttgataatttcgcatcatttactaatcattggtctttaagaagacttattctcaaaatacctatatatactgcggatgatttgatagtattccaattttttcgatttgattttttaaattattatatttttattagttgtaaaatttgttaggtttgtgtatacttatatctaggtacagagagagagagtagagaaatgaaacctctaatatgcaacgtagatacataacaatggcaaatgaggaaaagaattcgggaggagctgtaaaaaaagaaggtgattcggttgatatatttttgaggaagggtatccgtgcctggcttacacaggaacaacaaaagaatcctcacttattttcattcctccaggatgacgacactgagattttgaatagcatcctcagaagacaagaccaaagaaagagagaagaagcaagaaagagagaagaagaaggcacgtccaccaaaggtgctagcaatagcagtgctaataataatgttggagattccaagaattacaaggccatgtgaacaaattaaagattcaagaaatgaagggatgtgaggtgaagtttgttggaactagctctccctagatctctgaatatctacaagcacttcttcagtttatctttaattcaaaaaataaactctatgcatttgtcttcaagttcaaacaataactctgttgcataacaatgttatatatcctttagttgtttatgtaacaattaccctgtgccctgtgctgcatgccagattagtgaaggcatcaaaggcccttgcatacgtttatcaatccatcacgatgataatgaatcatatttatctcaaatacttgttagatttcgttgcaatcaactaatcatgatgataattaattataagttttattaatgattaataataaaggttttaaattgcaattacaatcaattcattaggttaaaaactaatcttattcgtacgtgatgactactgattcaactttttttttttttgcatcaaatacaattttttcactaaatacatcatttttccatatatgaatgcaatggagcattacacctttatatcaaccttatgaattaaaaacaaaatatttcttttacatcatgcaagtacatataattcgtagggaaaataggaaaaaaaagaaagaataaaatgtttttgtgtaatagagacattaaacttggaactcaaacgttcacaaatacaattttttagaccaagtaggaattaaaaatgagctaggaagatctaatgttgaaggagagacgaatctgtgagaaaggaggacttgtaaacaaagcaagagcgaattgagaagaataggtagtggtggggtatatatagtagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgttgaagtttatttattacaaatacttaaattaacaattaatagcaaagatattataaattttatataatattttgtttatatgctacactatatgaaataacaaagagatatatttggataaaaaaattaattcacttgaatggaacattaaaaaatataataagtacaaaattaaaatataatgtgattcaaaaattatttttccattcgagatgaaagtaaaataaaataataaagtaattatttgacacgaatttgttatttggtttatattttacaaaaacattagaagtatttgattacttagcttctatatatgtgtgttacatattacttgtttcctttaattttcatgtgatatagactaagtgtcttgattcatggtcctttctcttttgttaaaaactttccttttgcattgcaatattgaaaaagtagccgttaataactctactactatacaaatactcttggcaactaaaacatcaaatcttatgtaagatatcctccctctcacacgagcaaaatatagaagagaagaaatctttcttggatgccaaatattttcctttgatttcatttctttttgtttatagatttgatatcacgatgtctggtaggtgtgcagcttgcaagaatcaaagaagaaaatgcccttcagattgcattttctttccatattttcctgccaatgatcctgaaagatttgcgtgtgttcacagaatctatggtggcagcaatgttggaaaaatgcttcaggtgttttaaatatagataataatatttgatatcaatgtgtttatgttagtctataatatggaaaaatttatcaatatatcaaagttagaatatgtcatccaaagtcaataagattatgttactaaataacctttgtatattttgatgttgcagcatattccatcatacttacgtgaacaagctgcaagttctttgtattttgaagcacaatgtaggattcaagaccctgtttatggatgtgctgggattatctctaaattatatgaacaaatcaacagtacagaaattgcacttgcccatgtccaaactcaaattacttgtcaaaagcttcaagtcccacgggcaaaagctgaatcaaacttcaatgtcttgtcaacaattgaagctgaaccaaactttgatgtcttgccagcacaaagcagcagcacagcagaatttcaatgggaaagtcaagttccttggtttagttaaaactaccatttccaattgatacaaagcatttgatttatatttactatgatgtcacaaccattttcaaaacctcaattgctttaggagtcttttttttctctctgtttttgttggaaaacatagaataatgctgaaaagagttcagtgattcgtagtacttattattgaataatatcgttgtttatttgttgctattttataccttatacacaatcgcaatgttaagcataagcattcaagaacatgtcttctttacccaaaaataacaagtattcatgtgtgtaactctttaaacaatcaaaatactaatataaaatgctcatagatttcaattttgaaatatttattcaaaatgctcacatatgctctagctttgccaagatatttaaatactaaatttgtaaaacataaatataaattaaattatataactaaataaaatagacttactcaatgatttcttttgatttagaggaactattcataaacttcaattgaaaatatttttagaaattattcaaattctttaaaatggagaaaagatataacatcttgaagtagttaaaaaaaaaatttaaaaaatacgaagcgtgacttttatgttttaataatcataaaaaattatttacctaaacaaccatccaaaatatgtaccaaaatgctattattcagagtaggtaattggctattttttcgtacccaaattgacttttgattcaccgaaatctcaacattctaaatcgggttaaataagattttggtgttatagtatttcaaatttcaagttttaattcctataattttttcttatttttagttatttgtttatcatgattagtgtttagggagttaatttttagtcattttgatgtctatttttagttcctctgagcaactaattattgtatttttagaatcacttagcaactaattattgtatttttagatcacttagcaacttatttaattcttcttaattttatatgttttattaatagagttcggcttttcaaatgaacatgcttttattttatttcattttaaatattaatttaatttagttgtattaatataatttgtttaaataattaaatatattataattaatttttttatttcaattattttaggggttaaaaatgtgttagaattaagatttaagattttgtactaaaagcatgcattttaattataaaaaatgatcaaattgtatttcagaaagccttaaaaactaatatcttgattaaaattatatatctataaataatataaaaattaatattgattggtcccacaacagaattaaaaataaatactatatcaaaatcaatatcctaaatggtgacaggtctcaccagtaaacatgcgtaaccttatactaaaaatactagattctccaacaatttaaagatcttgacgtggacttgtaggaaaatgtggattttaaaagcagatccaaacacactattggatttttttttctatcgctattgcacacacaaaaaatgcataaaaagttcattagatccttgcttggccagaaaactaacacaataacacattggttttttttttttttttttttttttttttatcagtagaataacacataggttacccgcacaatgaacgtgctgaataataatctcccaatcccttttaactagtgcctgaatattattgattctgcccaacatgaaattttaatagaatttttcatttgaattaagttccaacctaatctagacctaacaatatatagaataagattgaaattgtctgatttgttaacatgacaatgacatcaatttttatattatatataattaaatcacaaacttgataaaaatatataattacaattaaaatatattttaaaaataaataagtaagaaaatataatttaggtaaaacattgtgtattaaattatgtctgtattaaattatgtcagaaagttcaatcattaataactacgggtaaagttagtgagacagataagtcatgaacattactaattatagttggcttatttttaatttggtgtactatttgattagttgatgtcgcataaaatattttaaaatgtaatatcaaatattgcattttgatacttaaaaataatcatcttaaattttgtgtgtatatttgtcataatcacatcacatataaaaaagagttaaattgataaaatttaccactcgctttaaagttatgtacttatgtgggtgcgttgatcctccaaaataaatatcctaatagtcaactatgaaactttaggtacttttaaattgaaaaacttgcaagttttgaattcataacttgatctctcggagggttatgcacctgtagctggcttctttccatcaatgaacaagcccatggttttgaaccaccgcatcagatttcgatgttccttcacatatagccacgcttgaagaaatttaaagaggctctcgttcactcctcgctcctcaatgtaactgtgaaacgcatctctcatcttttcatctagttctctgtcatttacagaaaagtcagtcaaaactaaaaaaaatgcctgcggcacaaaacataagaatttccaagcgaagtttaacaggtatatgataaaacacaaaacgggcattctaggacaacacgcgtattcgtatcttccaaaagtaagaaattttttcttctcccaaaatgcaaaacacaattccgcagtttcttctctaagtccagcctatcttttctcagagaaagagcatcaaaatgaatcaatcacatcacattgacattgaccttaattaaacactcacaattgagttccaaaatgaaatgaagtaactcgcacggtagagatattttcaacaatagttattactataataataaataaaataaaaagagccaatacaccactactccttacagcaattgaagagttctgagtggagggcattctacttcatctccattcttttaatcctaaattcctaatatctacaaaaaaattaaatgcttcttcccaaaatctacattttatacctaaatatagaactcggttttctaagaatttgggttttgaacttaattcaatctcaaaatctaacttagagggagaagtgattccccacctatatatactattttggtcgtatcaatagttaacgtgaaatctccaagagacatgcttaccccggaaattacacacaacttatagcttgcaagattgaatatttgtaggtgatccaataacaacacctgataacgagtagtctaataaatccaacaacaaccactaggattccaatgccatattagaacttcaaaatctaactcatgcgataagtgttgttccccacttaaatcatatcaccagtaaacgtggaatctccgtccatgtttgatatatctttttccaccttatactttcatatactctagagattgcaatgacattaatttaagaatttaacggtgatgcacggacagtatatagttttgtaaaaatcaacaaacctactatccgtgatttgtgattggatgattttacactatgagtgcatactttttttcttcttcgtaatttaattaccaatctccagacctacgctacagaagcataaaccctaaacaaagaaaaattgagagcaaagagcacagaactgacgcgaaaacagggccggtgtattgggaggggatgaggaggtagccggagtcctggaccttgggcctcatggaaacagagtgaattcccagagcatcctcgtacaaaccgcagaggaaaatcaaggattcgttctgctgaggtttggagacgtctacgtggatgaagagctggtcgatggcggaatcctcgtcttcgggggtcaacaaccgcatgacatagatgctcacctcttcgtcgccgtagctgcgcttcagaaccggaccgtgcgagtccagagctcccttcacgatcgtgaacggcgacggaggactcactttctgctaggcacgtgccactctcacgtgagttagtcaatgtctaaacctaaagtaaaaccctagtacataacagagtgagagagagcttacagggggcatgttcattttggcgacttcttgatagtgatcctttagagagcggaggagcattgagttcaccgcggaggagatgccgtcacctcccgacgaatatggccgccggagagcacccacggcgccgaccaaggttctcttccacatttctctatcttttccttctattcctgcgctgtatgagattgtgttgtggcagcagctcaacccaactcagactactcaactcaaacatttcaacaaaattatattaagagtttaatttattaatcaatcacaaataattttaattacaatttttagtatttattataaaagctaattatcttactatgtatatataatttactttcaaagaacaaaaaccatttttttccaacaaattattatgattgtgaaaataataaaattgacaattttattataaattaaagtttgataatactagtagtatttactattagaagttatttaattttattttctcattttttctatatagttaatttttaatataaattaattaatataaataattttatattttttaggcataaacatttttttagtcgttttttcattaatccctcaacttttcaaaaaattaagtttaatacctccttgttcatcaattcatggtttcataatttgttccaatttttaaccatcaatcaaaatttattattatcaattttataaaaagtgatttataacaattttaaattatcaaaatatttgactcgtagtataatttggtgacactttttgtatattttgacaattttaaacaagaaaaataaaaatatgaatgtgaacttgtgacgatttttaaaatatttttatgattttaaactgtcacaattttttttaaagaaatcaaactaaaaaaatatatttttgatggtaaaaaatggttacaaattataatatcattaacgcaaaaaataaaaaggactaaaaacaacttttcaaaaaaattgacatgttcttttgcaccacaaaagtgttcaaacacaagctaaaatcaattatacaaaatcaagtttattgaaaatgaatttaagaagctccaattcacacacatagtatatgtttgatttgtaattgaaattgttgtaacacacattttaatgcaaatccaacagataaaaacaaaataaatgcaaaagcaagaatcgtgatgcgttggcaaaatgacttttgcctctaatgtaattttaaaacggagaaccaaacatgcacaacaattgtagcttaaagcctgttgtcatctgactcaaatcaaaattatagttgcagctaaaatttttgctttagaaaatttgtttctccgtttgagatatttcaaaacagggtataaattgccagacactgtcctttttctcatcaaccattctcataatagtcgattttaaacagttttgacagaattgccatgcatcacaccattccgcaaaacaatgccactctcagcagaagcaccgttaggtagcagtaccacatcaataactttgggccaaatatcatgcagaaagaatcctttatccttctgaatcaagagcttcttccaaagcaatgatgttggaaaattaattttacatttccacaataaatggaacaaagcaacaggcaatcatatttcttccataacatgggcaactgaacaatttttcattttgtgagaaacctcaaacaaggcacaaattgaaagccctgatctttctgacttgtcaaaggagatatcttaagattcaaaatctgtatgaccaacaacttcttactatatacagaagaagttaatactactagtacattttggggcaactgaaaaatgcatgtgatgtgagaattctatgagcttcggccatgaagggacttgcttgcttgtgaggctaagaccattgccttggctcttgtgctcatcagcatcaattccctcactgcacgacgctgatgttgccgggcatttttagctcgcttcggagctaatcggttgtccctttccacaaatgcaagtctgaatttttcagctactgataattcagtggaacttgaagatggagagatgggcttcaatgcaaacacatgcattgtccatgttctgggatcaatatccttgacaacttcatcatccaatatgatattttgtaatgcttcccgaggaacctcagttcccttaaacccaaagggtgatgacttaggatttactacaacacgtgggcactcagtggaaaagtcctctaaagaatttttatcaatgtttggctgcaaataaaataaaataatcacttctggaagaaatgtcggccatgaaaaagtattaaactattagcaacttctattttctatatgcaatgagaatcaaagaaaaatccttatccatgatgcctattttttcctaattctcactccatcccccattggctggaggaagtgcagcgtatatgtccctacaccaaccaatgctatcataaaaacaaagacatgaatttttgcatttcagtaaggacaaaaattggcattcaattacaaattagacaggagttttcaagttcatacccatactagccacctgagtgattgtgccccactagcaatttcttttgtatcaagctcctcccaagaatcctcctccacataatcatcaaaccttggtttaaatatacccaagcatcttcgtgcagtgttgtcactccttggacatcctctgcaatattagttatggttcattgcctgttatgagttttgtaatgatgtaatcctagtcaaaacacagtcttgtatccaatgtgatttattagacaaaaatcagtgtgtaataaagtaggaaattactaccatgaaaacaacaaaaaagaaaagaaaagaaaaagcaccctaaacgattttaaaattacataattttccacctttttaatttaatttgatttttaaaacaaagagagaataaatatagaataaatttcccaatacctacaacttcccaagtttcggataacatttgcttcgtgagaatagacatcaattttttatatcaaagccaatttttggcattataaataaatgagtaagtaaatatgttttgatcatctttacaagagaactcaatttacagatcctatcgacaaaagtatgacagatacaatagtaacaagaacatggtacctaaagggcccattgaagcaaaattacaagttttcagattatgtcttaaatgatcgacaaaatacagtctaaaacaacacaatgaacaaattgcattaacaaagaaataaaacttaaagtggataacataggatatgtacccgcatctcaatgtctccaataagtggcagtgcttcacaagctcggatataccattagcagtaattttggtgcaccggctgcaaatagtctcaatatatcaagtgattctgaaagagagagaagtataatataaaaaaacacactacaaaactacaaaaatgattgttagcatcacatcaatcctacaatatgctaacctcaaggcaagttgttgacggaccaaaaactaggtgaagaaaattaataataaccacatccagtagaagtaaaaccatgaaatacaattaaaattacaatggaagaggaagatctaagcataaaactcaatctgcattcatcactcacttctaataaactcatgatatagttcaaacagcaaaatattttctcaaaatgtgcctaccagctggtccattgaatgggacatatgacatgctcttgtagcatcaagtaagcttcagagttaagactacaagctagagcatattgcatgaaatgtcttctgaaatttgaatatacatgaaaagactaaatattatgaaaattcttgttttttcagattatttattctcatttctcagacatcaaagattgattgcattacaattaaagcatagtaattgtttcatttttttaataaaaaaagttatagttctataccttatatctagagctttaatgaatctacatacttcagctgcttttatcaagccaaaatcagagacatctgagccagagacatcaaggatttcccaggaagtatcagctaatgcgatcaggatatcatcattcagcaatttccttcttctagcaatagctgccactgctatctgtcattaagcataactaacttttttatttgtattgtatgtatgtataaagtacatgatgcaggatgaaggattctttttgttcttttttgggggaagacacattataatcagagatttttaacaagggataaacaaagaagtgtttaggacagtgagcggaacacaagtttcaaacacttaagaatattaaccgggtgcctcaacaaaggatatttctttagcaaagaaagcgggaaatcctggagaaatctttgtttcccacacatttacattgagaacactataaatttagaatttcacttgttgacaagtatgagcattaggataaatgacttattaaaggatttgaagaatcagaatcattctctagcaacctacctttatatcagctggcaagttgatagcaatttcactcaaatctgcaacaatatcctccaaatgtcttccaagaactccaatgcaaagactgactaaactcggtggctttgtcttcttaggcagtaatcctgcaccaaaatttctcaaataatttgttaatgcctattatgtggcacatgcttatgaaaaaataattggtgcatcgtgccaccaaggtttaaaccctaagatctcatttaaactaccaaaacctctcacaactaacacccacctagtgtctccttcaaagagaacaaattttagtcattctattcaggggcaaaactcaaactgagcttccattgtcagcataatctagtcatacaaacacagagtctaagggcaaaaccaaattaaacaatgagcacttgccacaaaaccaggcaatatgatcaaaactgaaaccaatcgcagtaaaaggcccaaatgagggttgaagtgtttttttgtttgttttttaagttttctacttaaaattatcacagaaacaaagaaccactgcattttagagttagtattgttttgtcaacggtctttcaatttcaattgatccccaaaacagagcaagtgcaattgatcatgggtcaatgaaaggtgaaagctttaccaaaaaccaaacataaacataacaccccatctctaaaatacaaaagcagattgaaagagagaaaaaggggtttaaaaaataccgggaaattgagggtgggtgattgaaatggaagacttggatttgacgttggatggtggattcaaatcgaggttttgcaaagaggtcgctaatgccttgtcacctttacctttatccatccaaaatcaaaatgaaaaacgatgtaacagaacgtgcccttacacaatacctcaattctgaggaaccaaatttgacggtgttatcaacttattctagtctctctctcttcttgtgttctgaaataaacgaagccgactttacttgcgacctcctttggaaaaattaattattttctgtattaattttaatatattgttgcctatcgattttgttaaaaaataagtagtacggttactacggtatacagtacatttttatttttacataataaaaagttataacagactaatacttttcaatatataaatatgttatattaaaatttataataagtaaatatttttaaatatatataatttatgtttaaatttataataaaaaattaagttataatttaaagttatttttttaactattcttatgtttttttagaaaaaaaactgttaaaatataatttaaagataaggattacaaaaatggtatattgaaatagactagcagttaaaatgattaagtatatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtgttaaaaattttgctcaaggtgaggtgaggattatattgtgtttggatataaggttaaaactgttttttttaagagtttttttattgaaaaaatttatatttttaataatttttttttcaaacacttataactcttatgtctaatttgttatcgtctcaatatgtattaataaatttaattgattatttctcttaaaaaaaagtctcattgtttgttatgaacaaaatcatacagtagtattagtgatgatatatagtacagattaaactcataaagtattaaatatttcaaaagtaggtttggtttgttacaatcggcaaaaccaaacatacatttgtcgtaactcgtaattaaattagttaggcttttgtcaactgggcaactgtccagtgtccagtctacttaggtgtaaaaaagcgtcattttttagagtttaatttttatgtagtgttagtataaaatatttccattattaattaatacttaattagtattctttttctattatacataaatataaatatttgttggatatttttaaaactatacattactaattctttgtgtattttgatgtttctaatcatttattcattttttattaatcccttatttattttaatatatgtatgctaattcatataaatgatattaaaaatttaaaaagggtacaaaattatggttgatatgtttttaattttttttacaacgatatgttttctaaaagttaataagattatcatataataatacatataatcgacattgtaaataaatgataatataatttttttagatcatccgtgaagagattagttactttttttatgtaacacttaaaatattatcattttaagtaaaaagattatgcttttcatatgaattcccattccagttagtaaaaatgaaactctccgttttaaaaagaatcagattcattctgattcgaacgtaatataaacatatttatctacttttgtttaacaatataaaactttgaaataattcctttattttattataaaagatagcagtgaagacgacattacttcaattcacagtaaacaaaaaattttgggcccaaggagcattcatagaaaaaattacatttactttactttaagataacaagtgagagtttgaatttatgacttgaaagataaactcagtttcatttcattggacttgcttgagttttgttttttcttccaataattcatgacacagtataaaaacttttatgattaagtaatttaaagtttaatttctgttgccatgattttatccttttaagaaaagttaaattttaatataagaaaaataaatttatagattacacttcaaactcgcgaaacacgttgaaaatacaataattatttgtgtctaatacttaaaggggactttttagtctttaggtaacactttaacgtttgataattggtaagcattgactagggacaaaactcacataactactccatttgatataggtgtggtgtgctatactttagtaacgtagtgagctaatcccacttgcgtgggtgagttaaataaaaatgcgggtaaaatctatttttggttcttgtatttttatttaaaattagttttaggttctgtattaattttcaaattgattattttgatcttcaaaatttaaaaaatatgtaaatttagctccttaacagcattaacattgttaaaggaaaaggactaactctgcatatttttcaaattttgaaaaccaaaaatggttgatttgaagttacgaagattaaatcctattttgatccgtttaaaataaaaatattaaataaaagaaattttgaaaaaatattttaaaaaaatttaaatgttacaacttatttattcattttaattttaaaataaatagccaatgtactaatagtataaaaagatattaattaattttacaataatttttttaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagaataagaattatggtatatgtggaatttttttacttaatttatactcatatatatggtcaaatatatacatttttaattcaaaagtgagtaagagtaaattaatataattatttataattatccatgtgataatgttaaccacttttaagattcaattaactattattattagataatactaatatctaagaatatctttaataccggatcttgagtataaattttaagatgaagatctaatcttgggaatagatcttaaacagaagatatgatcttggggataaatcttaaggatgtggaacgagtatttggtgtgctataatctcaattcgtgattatatgtagttcatcgcatgcctggaacatggatacaatgaaaaatataattttggcatgcattatattacataacatgattgtcgaagacgaacgagatacatttagtggtaatatcgatgttgattattatcacatagacaatgacatttcaaatgttaaagcatctcgtgatactctcctgattttactacatacttgcaaacaagacatattatgtgtacaaaaagaattgatcaacaacttcaagcatatttagtagaacatatttgagaatgttatcgtcacaacaataataaaatttaattttttttggcattaatgtgttgtatttttttattatcaaatttatgtattatttattattttaacatttagtcataaataaaaaataaatttatgcttattttcctatttcttaatatttataaaaaaattcttacatgttttattaattaaatttaattacttaattaattatatttaatttaataaatatttatataaaatatttaaaaataagatctatataggacctattaaaaattatctaagatgagatctaccactaaaaaaatgaaaaaaatctaaaagatttttaattttatgtaacacattaaaattcataaaaaattatataagatttcaatttgattttataagaaattatatctaactttttattcctttataaaaaaaatataactttttagttttttctcaactaaactaattgatgaacttaaacctgctttaaccaacataaagttagcagctagctgaatttcacaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaatagcagcctagttttccctgtctatttaagcctagttcttgtgcccattaatgcagtcaggtccacctctcacattaacatatcaagcaactagcttctcaaattgcattcctattacataacataacaccctccatccttggacttaattcacactcccaacgcttcctctttctcccataaataccttcattcatttcaacaccaccaccaccaccacttcctcacttttgttactttcctagtttttctctcaatatggttatggttggagcccttctcctcaacgccaacttcaagattcatttctcacgcatatcaagccaagcccctgtccccttacccgtcaagcccgcatcgctcagaatgcccactccctactacccccactgggcctccttgcaggccgacattgaagcccacctcaaacaaaccattcccgtcaaagaacccctcgaggtcttcgagcccatgttccaccttgccttcgccgccccccggaccaccgtcccggctctatgcctcgccgcctgcgagcttgtcggcggtcacagccaacaagccatggccgcggcatcggccttgttactcaacctcgccaatgcacacgcccatgaacaccttcctctaaccgacaggcctgggtccaggcccatgtacggccccaacataaaactcctcaccggggacgggatggttccgttcgggtttgagttgctggcgaggcccgacgggccagcacgtgcgagcccggagcgagtcctgcgtgtgatagttgagatatcacgtgcggtggggttggtggggttgcaagaggcgcagtacgtgaaaaaaacgttgtggaagggtgaatcggacggtggtgaggaggtgcaacacgtggaaagcatgcaacgcgttgtattggagaaaagggacggtgggttgcatgcatgtggggctgcgtgtggtgccatgttgggaggtgggagtgaggaccaaattgaaaggttgagaaaatttggattccatgtggggatgatgaggggaatgctagaaatggggttcaaggaaaaacatgtggaagaggagagagagcttgcactcaaggaattgcaatttttcatggacagagatgttcatgttcttcatcttatttctagttttctttattaatttctagccagttttaaggaatctatctggaatctcaagtgggttattatccatttacatatgtacggaacaatggaacatgatcaactgtgcagttcataaagaataattgcacgatcatgcgtttcaaatctgatggtatgtatagcagaagtttttaaattatattttactttataattttactatatggagactccaatcttcatatagtatgatggaggtagatctaatgtttttttttggttgtgtgaggagagaaataaagtagaaacaaagtattgttaggttgtttggttttaaaaaaatatatgagaattaattgagtgaaaataaaatgataaagttataaaatgttaagattacatattatttatttgtgataagatagcaattagtaatttagtcctcattatttattattagattgattatatgtaatcaatattgatcatatttgttcattataaataaatggttagtgttgtcgtccttaacacataaagtaaaatattgttatatgatataaaaatttagattattcttcacaaagaatagtgaaaatcatgctccatcgatgatttagtgtcaagtccccggtggaccttttgctcgttgcccatcttccagtgaccatttctcctttcctaatgacttttctgagcgactattcttgccattgtcccgaaccaaacagttttagttactttttgtttttttccctcttttctctatcgcaacccctttgttgcttgaatagtatcatgactattgtgagcactggcagagctacattagaatgaggggaggggggcgcaaatgcaccccctcattttaataaaatcactagtatttattctaaaatattatattttgcacactctaattttatgtatttgaacctccttaccagttcacatgtgagagtaagtaaatgcacaattttattttaataaaatacaaatatttatcttaaaattttatattttgtacctcttatcttcgtgtttaaatctaattattctatatgataataatagttatcaatttttatttttttaaataaattgatcccactgacccagagtcctagatccgcccattgattgtgagcactattacattgccactatgttgcctttttgtcgatgtgcctagatgatcgaaagtgtctccctctagcgaacccaacatcgcaaatctcattgtcgtatgtcaccaccctccgatgcgagacactcacgcgcctgcaccgaatcaacatgtgatgttgttttttgaatgacccatcctccgatgacctccccatcgtgcttcttcttttctagaaaaacctatttttgcttcatttggctcgatttgcatttgtttggttgctttggctattgtatctaccatcctagctagtagttggccaaatagccatgtgacacattttccagcgtgacctacgttcagtgaccatgtcatcattctcatcttcttccgacaaccctatttcgttgctgtttgactctgttttgtcgttgtttggttgacccacaatccagcgatcgcatcatcgcactttgtctctttccagcgacctagtcaaagaccaccatgccatccacgtgcatagccaactcaaaacaccacaacatgcgccccacatagggtcttggtgcgtgatgatcatgcacacgacacataacacatctccaacaagcatcacagtggtcttcgtcatcattgcgagcctttgttggctgccatcgaatcatgtttatccgatacaagcacactacttgaattacctttaatttttatcgaattgaccacatttataacaagctcgagcttaagggagattacatatcattctgttatttgtgattagataataattagtgatttagtctttattagtcattattagatttatcttatataatcaatactgatcatatttatttattataaataaaggtttaatgtaatcatccttaacacaacattacagtaatactgtcatatgaaaaatattgatatatccttattaatatatgttttttttttatcaaatgaatcagtttgatgataaaaaagacaaaaaagaaaaacacaaacataaatgtacacacctcatccttaccaaggacaaaaatttcaaaggaggaacgcaccttctcccaattaattaaattaaatcttgctcacaaatcaactccataaaaccacctaaaaaaactccattgttgctcgttgtccctatcttgtcgctgacaaccacaacttcaaaggatggtttgattgtgtgggggagaggttactatttaagggaaaaaaattaaaaaatagtgcgtctgacatttattttttattttaattcaaatattttttttccgtttctctttcattcttttctcttctatacaaacaaacctaccccaagggatacaagtacacaaggcaaaataatcctagaaatattttctctacaaagaaaaagctagacagggctctaactatagtgacaactacgttaggtgtgagttctgatcacttttccttagtgattgattttattccaaaaatgagaagtgataaaaaaaagtacaatttaaatatatagtctcagttaatataccaaaatttagatttagttattcaaaataacttttgttggatttgatttttatatattttttaaatggtcgctaacattatttagtgattgcaggacatgtatgaagacatgttacctcggtgactattttttgacatgttatgccaatgtcattaataaatgataatagagaccattttaaattttaaaaatttatatgaattaaaaccaataaaaaattgaaggattaaaacaagaattcacagtatttatacataataacagtatattttaccaaaacttaaatacgaggcattatgggaaaagtacaagcattgtggaaccttagtgaaaaaaggatagagacaagggaagggtaaggaagatgctgggaaatagttaactgaaaaattaaaaaatctgcaaaaataccttactacagcggcacataaagacttcaattttttcaaatgcaaatctatagatttctagactctaacaaagactaacagttctttgaaatgacccccataataataaaacttgtgaggaaatggaaagtaatcaaaggaggactatggaagtagaactactgtgtgtaaagatttagattgaaatgactgaaatggggagataataacaagagtttatttcatgctactacaatccaaagatataggatatgcttagacaaattgaaaggtgacagtaaggcatggttggaaggttaatattacagacttatgaatgtaatcactttagacacattagtccccataattttaatgttcaaggtattgtaaagattattgtgttactgttaagtttagggttctataacataattgatttctccatatctgagtacctttgtaggagccagattaattaaagacaaaatagtcatagcacatgaggactttcatgctttgaagagaaggagcaaagaaggcacaaaaagaatagccctaaagcttgacgtgagtaaagcctatgagaaattagaatggactttcttggagaaggctctaatagcatatgggtctggggataaatgggctaagttagttatggccttattgtctagtataacatatacagtctaaatgtgttccaaagtcctacagaggcctcaagcccatttattattcttgcctcaaatactctctctcaaatattttagaaagaataaatcattaatttcgtttttaaagtattactgtctcccttaaattatccataaatcaagaaaaccatttaaataatccttaaagtattgaataaccataacttttaatttaagttaatgtatttttaacaaagtttaagaactattttgaaggtattttttaatatttggagaactacttaacacaactttttatacttttgggatcacctgagtagttgtttttttttataaaaaaaatagagagtatttagaagagagtaatatttgaaggatgaattgattattaagaaagctcttacatatggagatttattgtgaaccccttctagcccaactctttcctacgtaccttctatttgaagattatgctcttatctttgggattacttgtgctggagaagctgtccatatttttaacctgtcctgggtcaaaggattaacttagcaaagtctggattaatctttggcaaatatattctactgctactaataaaagagatatctattattagtgtcttaggaaaagaagcttgggaaattgttggtaattatcttggtctcccaacagaatggggcagatctagaaatatcactcttcagtggattagggagaagaggtaactctaatcaaagtcgtctttcaaagggattccctcttatgcaatgcctgttatacactttcctaagtctttttgtacctttctaatttcctcagtagctaggttctgatggaggaataagggtaggaaaaggattgcactagaatagttggcaaatattgtcctttggtagcattactaatctagcaaagtagaattggcgggcttatagagacccaaattcattatttttgtttcatgggtttgacacagtattcttcaaggcaaggagtttgttaagtagggtcattgaaccataataaacgagaataaggtaggtattaaatgatagtagatgaattagagccattcgaccccattctaagtttggattatttagttaagagaagctatcatgttgctaaacaaatatcatgtgaagtgagaagatcaatgagctcctcttcataattaaggcaccccatataaggttagacattttctagggaaggtcttccataatgcttttttggtcataacaaacattttcgctatgaagcatggctgtctatctactatgtatgttgtcccatctggtgcaagagacaaatcagcatactctgttactctgtccctagacctaactagtttgatttaggacacaaatacaatgctatttttattttacgtgtcaaagattaatcaagtacattctatatcccttatgttgtggtactggtatatttggaaagcaagaaacaaattgatcaatcaaaacaatactcataatcctaccatttagtttacatttaatcgttgcaatcattaaaacaatagaatatatgaaaacttttttttattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgggtctcactaaaataattgttcaaatttattcaaaaatatgttgaaaacatcctgttggtaatatttgactttttgttcctcctacagtggcatgtagtttatatttagagaactaaattaaacacggaatctgtcgtgaaagaagttgatacttgataggttgactgtactataatgctactagaattgtgcacaatagataactttattatttctttaagtatttctcctttttttttttatcagttatgtatttctgatttaaaattttaaaaaaagaggtcttaatcagtgtatttgcatttaataattttttggcatggatattcgaaacagacaataaaggtaaaaaattgattgggaaaaaaataaaactcgtttaaaattgaaatgagctacaaaaagcgtacactagacgtaggttgtattaaattaatcttatggagatcaaagctgaaaattgatagggactactacatactgggtgtttctgtttccccttcccttctcacattatcacacgtcattagatactatacattgatctagtctataattattagatgacacgaagttggtgaatgtctatgtcaatttcccaccccacaacatgattgaataatttagacccttcttacagagttctggtaataaaagtctcgttatttttaagatttataaatgcttgtcgttctaaattggaccaacaaacaattatttgaggctaatcgagtttataccacatttattagaaattctcaactcatatagctttacacaaacgagtaactcatttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgagaaaattgcacagtctatgtatattacaactttgtggaagttgtataactaatattattttccgactcgtgtaagggttattcaattttgtcatggactttgatttcacttaatactatactacatccgatcctttttactaaaaacaacaaaaaagtaatagtctaaaatatattatcacttgtttcttgtaaaaaatacggtaggtaatagcacccaaatggggaaaaaatagcattaaaaacatagaaaaaaaatgattcacgcatcaatgatgtagagagtaataatttttatatacttctgttttctaacaactccttctccaccttctttttctatgtataattgtatctgttgttttcgctcatcacatttcttattttctatcccatcacttcttatcactctcacagaatctttattcattacagagtaataaaggaatagggaagtagaccaaggcttggacagttggacttgtgcacagggaaaacaaaggggaaaagaaaacaaaaactcacagaaaatcacagtcaaagtaaaatagaaaaacacttatatccttcaaaatgttttatggctctataattatgattcaccattaagtttgtatggatgctcaaaaccacacatctgatcccatgaatttgttataacagaaggagaatgaaaccagttatgattgccacaaccaatttgattcattgttttcatggtaaatggctaaacaattcttttatataccccaagcatatgaacacaacatccattcctaaataacctctaactacaaaccccactatacatcccaaatgtaaaagagctactatcatgtttggataacacataagaataaattctaccccatataatcaggtgataccataaaaaaagtagaagaaactatttgttgtttttacctacaccatgaaaaattaattgattatgttttaccataaagctacatcactactcaagagacccctttatagtgattcaaggaaaccagtttttgagagtacagcatttctcactttgctaagatccctacctttgagggttctcccagcaccttctaaaacagaaaatgaggatatctgactccttgcaagccttctggcaataaactcatgtggaggaagcttatcactgtcatcattttcctctccatcctcatcactactcccaccatagttagcaacaccatcatcatcaccatcataatcaccatcaaaccttgaactagcactattcttggggggtttagtgctataaatctttgaccagtcaggaatgttgacaggtgctgattgctgaagaaccttatcttcattggaggaactagcactgctgctattgctagatcttgggatcattctggctgaactaggcctagcaggaacaggaacaggaacagaagagggttgatctttgtctttgaacttgcgaaccccagaagtaccataatcactacttctgttcttgaaaacatcccaaacttcttcttcatcaaagtctccatctctcaaggacttccatatcccactatgctgcctgcctagactatatttatcttccatcacaaatcaatcacttcctgcatagtcacataacacaaatgtgaagaaaattatctcaaattattgaactagaattttcactggtttaagcaaaagacaagaaggagaatttggaaattaaggggagaaattaagaaccaaaactataaatcacacggggtgattatatttgatacaataagatatttggtattttattgaggaaaaataaaaggaaccacctttatgttgttgttgttgttgtcctggaatcagaagcttgaaataacccaactttatattgattctaaagtggtttcttgctggaatatgcaaagaaaaaatgagttgtgaaatgagagatgagtcagcttggattaattctgataccataagaacttgaatttgactgaatatatatgacggtgagtcaaaatccataatattatggcttacctgaacaagtttgcagagagattataggagaaacagcaaagcaaagagagagcaagttcgttctttctgaaggggaaagaatgagacactgaatgataggtgtccacgtatttaactctggtacctcacaggattaacgttttacaacgtagtacatgtacatgcccactatcttttttattttcaacacctctgttctgagttctgaccgtctaaactttaaataattcaattagcaccttttatttttatttatatcgcatttattactaataactcatattatcaattcgagttaatgttgatgcacgaataatttaattcattactgtcatttaattataaattattatttaaattagtttaagataattattttaaaaattatcaaatttatcataaaattattattagatgattatatattttttttctttccatgagtccaccaagatttttgtttttattttttatttttttcacctactcattcacaaccatttccatataagtgatgattaattgagtttagtatacagtccaaaaaaaaattgagttgagtatatgttgtgaatctctaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttaatgtaaaattaattataagaaaattaatatctaaaaaatatactaaatacattaattttttagaacaaaataaatttataaatatattatattaataaacttaactgatattaaaattagatgctatatttgttaaatacaagcataattagcttcaataatacattgactataacatacacattcatctattataatatattatgttgattaatgaattttcatattgataaatgtttttttataaaattattatcataattgaaaattaagaatttcatacctgaaaatatagtttcaagaaacttattattttcattattatttggagcatattataatgtataaacttgttgaaataaaaggtaataaaatgcttaatcttataatacaaaaaattaatgaatatataatatattttttttgaagaaaattcataaattttgagaaattaactataaatataataaattaaaataaaatatttaaattcaataagatggaagtcaacaaatacatattaaactaataatacgagaaaacataaaaatattgtaatatatgatattaatactgttattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaaattaaactattaaaggacatgataattaattatgacatgtttctaagctatatactttttcatgataataaataataaatatattaaaagaatattacataaaagatagttattacaaactttactcttaaaaataagatagttataataagataaatttataagcatattatataattaaaattaatttcagattaatcttaaatgttatattaattaaatgtaatacataactaacttaaatacatattatcatgcactaatttcaatatatttccccgatacatgaatttccatgttaataaatatatttaaaaattattaaaatttcatacataaaaagtatactaaaaagtattttttcattattatttataataaattaatgtttcatttgtaactactagtatattaccactaaataaagttgataatttcttttattgattttttattgaaaatttatattattatacaaaacatgttgcctacaataaaatttgttaataaattataaactaataaaaaaattattttctcaacatcttttttttatatatattttaaattgtatgtttttttctccatatttatacaaattctcacgcacctcttgagataaagaacatttaccctttcaataagtacccacaactgatgattaattttttccttcagtatttctttcattaaataattttatactatcattcaatcataaattattattttttataaaaaaaatttagtatttaatattaataaacaggctgccataacatgtgtcaaccagaaaagttatacaagcacaacatagtaagtgtgatgctgcaatcatgattcaataagaaatcacataaatattgcagccatgtattcaccatagtagatccaatcccaaaacaataaaccaagtagacccgtgctcactcatgcatacaacagcactcaggggatctattttccaaacatacaaggagaagtcgaatccttttatcatggctttacaccagttccacgccctatatccaaattcatcacaaatcaaggttgataatgatataacttaataaacgcgagttgattaaattgtggtcgtgtcatttaataaatttttagatcctcttcgggttaaaatgttgtattgaagaacatatgcttgaaaattctaaggaagactacaagaaacgatggtatatacagcccccttgaatgggtggcgaacagataaagacaggctattctcgaggaaacagacaaaagagtcgaagtttcaacaacacatgaatacaaatgttggaaattgtgtaaaaaaatacttatgatgcgcatttgacccaaattatacgaccattttttgtcttgtcttcctctttttgttttttctttaacttattttcatcttagagcatacatttttattaccatatcatcaatagggaaggatatatatgatatactgatgtttgtgattagagtgataaggttacaaatatattttttagtacatttttagtatattataggagtattttaaatttaaatgaaatttctaaattaaaaataatttcaatattatcaatatattttattttatttatgaaaataaataaaatatatagtatttttaaaatttagaataaaaatataaaaaatatgttttttatatataactttaaatttaaaaataaatttaaattacggttatagggactatgataattttaaaattccttttagtttaaaaaatatatatttaatttacaatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacatattaattgtgatgaaacttgatgtaaatccttaagtaagggtcttacatttatgtcttatgaataataaaaaagtaattaaaaatagatatttgttaaaaataattagtcaggttatcaatgaaaaatatatagtaattaataagtaaaaataataaatattttacatctattacataatctattacatagttatatatatatatatatatatatattccaatgagacttttaaatacgttaatttaatataaaaaataaagttgaaaggaaggtaattaacgtaaaactattagtagataaaaaatgaaaaagttaaaattctattaggagaaagaaaattagcacacggaaatgatctctgttctggcacagcatttgcgcgctttgtcaaagtttttaattctttttttttcttttctgaaaaaaactgtgtaaattgaaaccaaagggaaatggttcgtggaagtttctgatgttgaagaagatcaacgtggcccacatacacccattgccaatccaccattcaacgtatatggatatgaaattttgtcagctgggagaataactcccaggatttagtgggaatcttatgtaaagaattaatctgctatataagattttccaccgttggagcagaatctttttgctaaaagctaagccatgcacagcattgaggtggcggctgtaaagtgacagcactggtattgagtacgataatcaacacttaacacagttaactgattttagtcataattaaaaatttatatattagtaattgttatgtcacttaattatttgatctcaccttaattttttgttgttgtattaatgggaattgcaacagtgtcattaggcggtttgtaataactcaaggtttgaatatatgcaacagaaatgtaattgaaactgacggcaatatatctcacttacttagccttccctttcttaatttcctgcaaattaaagttacgttggttgtctaatgtgcatcactgatgttggatattattggattacgtgcaaatgtttaattttgtattatactatgtaatacggatacacttgacgatgtttattatatatttttctgttggcgtatattaattgagagttttatacgtgttttaatttctttctttctttctttttaggtgggtgtggggttagagctagtatctgagcactgaagtatatttacgatggtgaagaaatgcgtatattacactcaagaattaatgccatatatgccaatcaatctcatccagttttcaccaaaaatgtagtttacgcagctgacaaggtagctgtatgtcataattcattaagtagtaacgagtgaagacaaaccccacgttcagccaaaaagttttcatagataacgatatgggaatgtaggccaaaccacgtgcattaggaggctatatttgtttctagtattttttgctttcaaagttcaaacatttactgatatatggtcacaattaatctacctgcaatgtacgtgaaatatggagacagacatacataactttggcttcaattcattttaagtttatttttttatatatattctacaattgaaattagaggtgtatttaataatcattatttatctttaatgccgaatttaattatagaggttataaaagtaaaattataattttaatgaggagaacaacgacaaaaagtatttccaattaagttctatcctatttgttttttattggctcaaagctaggaaacacgtgtctcttacaaaccttcaggttgaaagtacgttgaagggttggtgccctttataggtgatctttttagttaggtatgatgagagcaaggtcacaactgtaaatgcctctaatgctttaagtcaataagagtaagagttaagacgtggttagtgtttaaggcgtacttggtatatgatgctaattaagtcttctttataggcctttttcttagtgttcatatatatgacaagagattagatgagataacatgataatttgttacctattatggaatttaattatcattaagcgagatgataagaggttaactattaacatgtaatatgttatctattggtgttaaagagacaattaagtgtatcaatcgtacgtacaactaatatatatactagaatgtatgagtacatctttgtttgagaaattaaaaaaggaagtaattacattttagtttttggtattcaataaaaattagagaagaacagacacaaatgaacaactaagaaaaaaaaattcaataggcaagaatggtaggtattagaaatgctaggtatggggttgtagaaaccactggggtcgagctctaacttggcttccctttggcgcaaaattcatcagcatgggcaccattgtagtgattggcgtggtggcatcatgtgtagctaaccacgatatataccaagtgtgacatttttcgttgttggtttatcttgcaagtcttagccttttttttttttttttaggtgttgtcatcttttatcttttatgatacataaacactcattattttaaacattttatttatatctcttatttttctttatctctctcttcctaccaaataaactctagatatataccatatctatattttttctctttttactttcaattactaggtgttgcatagcattatggtgtccatctaacatttttaaaacctaaataattaagtgaaatcatgcaaattttgaacttagaatctcagaaatgtgaatcacatgaaaattgatacacttaggttattttctcataaaatttcattaagttaatgccatttttttgttatttgttttgcaaaaggacaataatttttctatattcaataatttttacacattaaattttatcaattcaaccgttaaattaaaattgcttataatatataattaaataagttatttttctatataaaatcttaaatttattagatacatcattaaataaatttaactaaatgcataatatatttttaaaaacataagtaaaatattgactatgacattacataataaaaaaatagttcacttatttaaaatttgatttgcatgatcttaaaatttgggtttggatataacttagacctcacaaaacttgcttatcccattaaatattttaatttgatcatgtaattagttaatatgtgttctcaaacatatacaatgtctcatatcgaggactaaccatctcatcttagacataaaatttgtaaaactgaacatttactagtagtttgataattaatgatctaatagtggttgtttgataagcataataacacttattaggatagattttgataacatttataaaatgtgagattgtgtttaacttaaatctacaaaactaacttataaaagtaaaatttgctcctacttatatattttattttagccatatattttagccgtgcatatgctgggcctgggccttattttcgatgggagggttgatttttctttgacaaatgctatatcagtaacatttttctctaagtacactccgcttttattttaattaaatttttttactatcattagtcctctctatacccaaaatattcctatatgctgtttaatcattactcgggaaattaatttccagaatactattttagtttttttgtttcagaaagtacatttcaaaatgcaatttgatatcatgtaacatacaaaatacaaaaaatacatgaaatagaataatgcaatttgatagaaaaatagaatgagtgggaaggttgtgcagaagcgcttgttgatatattttgggccagatttaaaaaaaaaaaagatgttttaggccttgggccaaactagtacacaaattagtttcactactgaattgtcccacagatgagtaattaaaccggtggtgaaaacatgcgtagaaaatcaagtgtatgttcaagacaatttttttttatcaacaaatattaatttgttaatttagttagaaatactaattgggagaatgcgagaaattaggcatggcaacgggacccgaacccgtgcgtacccgtccgaatccgccccgattttaatggggaaaaaccgaattttttgggttcgggttcgggttttccccgatagtcaaaagcgggggcgggggcgggtatggggttactgatacccgcccccgcccccgcccccgctccccgccccgtaataaaaaaataaaaaaaatactattttctaattttttttaattgaattgattgattttgttttgtaattttaaaattatgatcccatattttaaatatgagtttgttattattatttttttgttacataattaacttttttatctgatttttcaataaaaaaaattatattattttttttattttttaaattttaatcaaatagcgggggcggggcggggcggggaaaacccgacccccagcgggggcggggatggggatgggttttaaaacccgacggggaatgagggcgggggcggggagcgggtttgggggcggggacggggacggggaatgcaatacccgcccccgccccgccccgttgccatacctacgagaaatgttagtttgttgtatacccttctatattccaaaatgccccttcgcaatggacaaagcattgtttggcctagttaatgcatcattcctggttttatttgaatgaagtccatttgttgaagtttcctatgcaaataaataccacataatatgatcttgtgcatactttatagaggtacaactgtaaaagggtgctggtctggacaccattatcttgactctcaagattgggctgccaagggtcctttactactcgtgagctcaccaatgacaaaatgttatttcattatatttgtaagtttaatttttatacattatcagcgtaaattggtactaattttatggtaggtatagaaaaagttaacaaaaatttaatatatatcataatttgtaatagatgacagtaaaactctatagtctcactatttgagtgtatttattggactgctttcttgttttacaaatattttttcacttgcttgttcacatagggggtgaaaggagttattgcaagagctttgagagaattcaccgtggtaatctagttgggatggggatcatacccctctgcttcaaacatgaagaacacaagaactgacgggtcatgagtgattcaactttgatcttccaggaaaagttggtgacacagaacctggtcaagatgtttatgtgtccactgacattaattggcaaatcttttaaatgcaagctttgccttgatataagtttcttaattcatgtgccttctatatatggtttatcatctaagattgatcaatgcacttgcacacagtggcttcactaatcactatgatatatacttatttagcaactcaatttgcaggtggagctggcataccttgatcatagtggcattcttccctatgttatccgaaacttgattaagcaatgagcttttgtctctttggatttctgaggcacaccatcaccatgtgaaatgtgtggaacacaataaattccattttagattattttacgcatggatctgaatgcacttaatggcaaatcaatatgtttatgcaatgtttaattttcatgtattttatctattttatttaacacttcactgtactacaaaactgttaatctcaattatcatattacagtcaatccattgtttttattttttactaacttgagcgtgagacataaaactaaaaagatatattaatttttttaaaaaattaataaaaatgaagaggttaattattgtttgaatttatgatctattattttaaataataaataaaaaaccgaggcatgttgcaataacgtacagtaattaatataaacgagtatggatttaattaattaactttagctccaaaacattaactgtataaaatattattatcaaattattaatgataatcataaaaaactaagcctatcaccaactattgtgatatttcacttgcttttatagcagcctttcacgtactgatcattactttttaattattatcaccccaatataaatcttacaattttgttttataatatttctgatgaactaaaaaatattaacttaaaaaaattaataacaaacatcataaagttgtttgaaaagccaaaaatactcgttataaagaaaagaaaaaaaaaacacgaatttgtttgcatttttattatttagaaaaatgaattcttatttcctttaactcatttatctttaaataaaatccaactaattatatttatttcgaacatatatatatatatatatatatatatatatatatatattgttggcaaaaacaaattaagctgagaaatgaaagggaagagaggaagcaagtgtgacactgttccccaattttctgtgcttagagtgaagcatttcgaaacagcaagacacgatgccttcggctcaagatccattctacgttgtcaagcaagaaattcaagaatctgtaagtattttctcttttcccaaatcacctaggtttcgttttcggttcaatttggataataaagattacattcttttttttcatagatcatgcgatgcacttagaatttctgtatgatttctctgttactggtattagtggatccgtgactttacgtgattcatcttctcaagcctgattcctgagctgaaattattaattgggatatttttgctcctaatatcttatgtaattgatctgagtatgccattttttaatgcaaattttggattttggatagaacccaactgcgatctgtaattggaggataacactatgatttttggttttggggttgatgtgtaatttattggcttattaattttcattttctggtaagattgataagctgcaatctacgtttcaccaatgggaaaagactgctgatgctggcgagcgatccaatctatcaaaggaagttcttgctagttgtgaaagcattgaatggcaggtataccaattgtatttttttgaaccactgacaagttggttggcctataaatttttgttttaaatgagttttattcattcttccaacgtggtactagtatcatttgtatgaaatgggatttgtgtattattaggtacacgttagagggatgtttggattatattacaatctaggtcagaggtagggaaaggtatttcctgggggaaattttattgtggtaggaaggaaaaagagtgatgtgcacataactgtccaaaatgattctgacatatgctgcaatttttgtcaaatacatggtatttttttttatcacaaaaaagcagaagaatcattcactctgtgatcattgtgaggatgcaaatctttgtaaatttcagctaaatatcattgttaaattttaatgttaattagttaatataagagcttaataaatagtgaaatgcattatattcatgtatttttattcatcattccgttccctccccccccattgtattttttagccacccaataaagggagagcaagatcatcaataccctctcccttttttccctcttgttttcttttaatttgattttgccccttccctttgggtctgtaaggaaagatgaaggggagtaaaaatggagtgagctggaaatgttttgattttcactctttgttggttgttaaatcagagagtggaaaacagatagaaagttacttctaactctactagcacatcttttatctagcctctctttgccacacatcttaggctatggtttttccttctgcaatacaacctattcaaactgctaaaatataatttttttgataggaaggtggatgaattggacaaagcaatttctgtagcctctagagatccttcttggtatggcattgatgaagtggaggttgaaaaccggaggacgtggacccgtgatgctcgcacccaggtatctataacatgctgatcttgagtaagagttaggagaatacagtcaaattttttctcaacctaatgtatagttcattcaacattgttttattgctagcacctattagattccctctctctctgtttttttttttatctgtatggtgcttgtgaatgattgtaatacattattaggtgagcacagcaaagaaagcagtgcaagctggaaagggcttaaacaatgctagtctaaatgggatgcacaaggaattaatgaggcttcctagttctcatcaaactacatctaaccaatttgctgcccaggataatgatgatttcatagagtcagaatcggacaggcagatgcttcttataaagtacttctttcctcccattttctctctctcactttatatggcattgaattaaatatttgtcttttgtcctgcttttacttgactttgtgcacatcttcatgatattaaactcattgacacttgaccgtgacttttgtgcatgcaaggtggaaaatattctcgtaattagtttgacctcttaagttgattgaattatattgtccactcctcctctatgctttctgagacgtaagtgggctcctctgtatgaaattgtggacacatgaacatatttttcttgtgcttctttacaaattataaatttctgttttttaatatcatctttgctaattatttaagttttgtttggattatactatttctattaaataagaaatattaactaaaatgatggattcccctttttttctgtggaagaataagaaaatgggggagagtaaagactgtggcaggtagccttaacacagataaaggctggaaatacagtgctcaagtgttttcggaaaataatcaatctctggtttctattttatttttgtcttatattttatctattggtgctgataggagacaagatgaggagttggatgagcttagtttaagtgtacaaagaataggaggtgttggacttactatacatgaagagctccttgcgcaggtagatttgacatttgacaagtttttggtctgtgatcttactattttgcttagtgggagagccttgttgctgtcttgtgagttggatgttactggtgtaaatactggaaacagcctctccccttgcggggttaaggcatttttactcgtgtttcaaaagtatgaaactaggcaaaactggtggtgcttatgtttcctttgagtgtcttcaatagtagctgtgttctcatgctgattttgtttccgtgggaaatttctcattctaaaattgtcaaagccttgatgtttcaggaaaagattattgatgaactgggtaatgagatggacattacttctaatcgcctagattttgtccaagtgagtttctgcttcgagtttccattattgcattaaaatgtatgatctatctggctgattgctgtgattaattagtaataatataaggagggcgagccctgacacaacggtaaagttgtgttttggtgacttgttgatcatgggttcgaatccggaaatagtctctttgcatatgcaagggtaaaactgcgtacaatatcccttttccttacctttgcatagcgaggagtctctggacaatggaatacgtagttttttttttttttttttttttttaatataaggagggaaatttttaatgttgaatgtgaaagttgaactgtgtctcattgtttatgatatcagaaaaaagtggcaatggtcatgaagaaggctagtgcaaagggacagatcatgatgatattgggtttgttggtgctgttcattttcctctttatcttggttttcttcacctagttattgagatgaaccttgtcaatgctctgtttgtacatggaaaaagatctaaagcttctgtgaagatacaagattattgggagattcaatatgtttaaaaaatgaatggaagcctctttggtttgtcaaaggcagtagaaaattttgattatgatgaaaagagaagcgatgtacttggaaatatcagaagaggaatttgtttctgaacaagatggattacaaatgtgatttaaattagttgtattcgttttaaagatgatttaaccctgcatgtaatgtttgatgtcgtttttttttctttttataacgacagcgtggtgttttgaatttatactttcatgactgtaccaaaatagcttatgatctatcttcatacaaatcaacccattatttacctgctcactcctggtggcatgatgatcttgtcggttgctgttttgtgttggcacagtagaatattgaggggaggataacatgttatctaatttggccagatatttcaaggtgtaatttttatgcaattgataaaaaatgaaaaatgaaggctgttgtattagtcattttgtgtctgttcagtattggtttgcttaagagtggtagggtgaaaaataaggtaatcatagccttctttgaataaaagaaaaagtaaaaataaaagggaaattggatatgtatatatgttatgcttggaaaaatcctttttttttttatttataaaaataactgagaaagataagaaggaaaacaagaatataataaaatcgataatgtgataaaaaaaaattaaaagataaagaaacgacttaaatgatttcctctaagtctaggttaccaaggtattatgtgagcgtcgcttgtctgagttccgagtttacatagtgccggttgttggagttttcaacgctccagtaactaagaaatgtcaaaataaatattaaaaaaatagttttcttataattttttttaattttattatttattttgtaaggcaaatattgtttttttttatatttctaaaatattaaatgtttttacatttttatttaattctttacagtattaagaagatttgtaagaagatctataagaagatataatgttattttgttggaaatgttttgtaaaaaaaaatactggaatttgtagagaaattgagagattaaaattcaagaaataaaattgcaattaaatttcataaaaagaattcatgtgtataggcttaaaatcaacatcttcctcaaaaatctgatatgttaattttgttaaaggtttaaatatgttttatccataataaatacttaaaatttgtatttgctttttaagaaatttttattttgtgtcgagtttctaataaaataataattttgtttgagtatctgataaatgaaaaaaaattattaggaacttaaaaaaatgtcaatgaccaaaaaaaattgttattttattagagagttaaagtaaaataaaaatctattagaaataaaatgtaaaatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggactggaataaattttgtttttcttttgtaaaaggatttgaaacaattattttttgtcccgatctttcttttgatcttctacagacaaatattataaaataatgcaaattgagaagtgataaaaattaaaagaattcgtatctgtaacactcagacaagcataaggaacagaatctccaaagcaatttgagtctagattcttctttcctttgttcttgttctctactacaactactatataccacacaaattatcttgcgtttctatgccttaaattacaaccagatatcaatcccatggagaataggatactgcatccacccaaaaacaccttatattctgctattaaccatcattagacccattgcaatctgtgagaaattgtcacattgtaagaattttttatttattttcagacatgtaaatcaatatttaacatctgtaaacttatatcaatatataatatatacacacatttaaaaaattactttatactatcaaatgtttaattgcatggtgtaaataatttgtcctaaaaaatttcactgctattaaattgcttattctgtcacgcacacccccctactatatatacccccaccactacctattcttctcaattcgctcttgctttgtttacaagtcctcctttctcacaggttcgtctctccttcaacattagatcttcctagcacatttttaattcctacttggtctaaaaaattgtgtttgtgaaagtttgagttccaagtttaatgtctctattacacaagaaagacattttattctcttttttttgctactttccttacgaattatatgtacttgcaagatgtgaaggaaagatttgattttaatccataaggttgacataactgtgtaataatgcaccattgcgttcatatatgagagaagatgtatttaatgaaaaaatttgtatttgatttcttctttgtgcaaatttttttgaatcaaaagcagtcacgcacctcgagtgagattagtttctaaacttaatgaattgagaggcattcatgatctctgacacaaaacaataaaaccgcgtgaaggaaagaaatgcttaataggaggctttagatttgttatggttagatatgttgatattggcatgcatgcatgaacatgtcacatgtggcttatggtgttgtacattttgttgcagctagggtggtgattagtgtacatatatatatatggttgaagtgggtatttatcacatccctacgagcactttcgacccatttgcggaggcaaaagaaacagatgcccccggggcaaaagagtatgtgcatatccgcatacaacagaggaatgggaagaagagtctgaccacagtgcaagggctgaagaaagagttcagctacgagaagatcctcaaagacctcaagaaagagttttgctgcaatggcaatgttgtgcatgacaaggagcttggcaagattatccaactccaaggtgatcagcgcaagaacgtttctcacttcctcattcatgctcgccttgttaggaaggatcagatcaagattcatggtttctaaccaactaccactaccacctttcttgtattatgaaattaaacctatggctgcgtttatgaaataactaaggagtttgagtttggaatatttggtcattttctctctgtatgattgaaaatccaagaatagtctgagagttgttatatatattattactacatgttgtgctttcatggaccatgttttaagctatttttatctgattttaatttttaagagtatcagtttaacaattctaaatttataagaccactataaattcgaacaaaataagttgttatatatgtgctaatatatatgaaataatgcgttgcctgcccttcaagaatcacttttaattttaagattagaaaagaaaagaatataaacaagaaccaaggctatttacttgcatgtgtgagacatttctcttgcctcgtaatcattagttctttgatgcaaggttgccttttttgagataagaaaaaaactttaatacaatggtttttgtacatttggtctacttaacacttgatcgcatgtgttaacaagattttatagttattatgacaaaggaaaatgtgtgggagatactttgatgttttaatatgcacaaatccgtgaatacatgcatgtatgataaaattgtcttatatatgattaaataataatttatgaaattttacattattttcaatgttattaaaattgattcgaaccgaccggttgaaccggttgaactaggaacctagtatcaatcgggccgagttggctaatgaaccggccatgcatatggcccaaagaaaaccatacggttttaggaagaaccgaaaatctggccgatttttaggacccagaccgagttggtgaagaaaaaaaaaagcttcagacgcataaaacgcaaaaaaaagcttcaacttttcttcatcttcaattcttcatttgttcacggcttagctcagggcctcaggcactcatgctcattgcagcagggcatgccatctccgtcattactagcgtgtgtgggtgcaacacagtgtagagattgacatggaggaagtgagaatgacttcggacggagcaacgttgatggcgacgaataagaggaaaccgtcgtggagggatagagagaacaacctccaaatgtagagatgatcgaagagaagattatatatatatatatatatatatattgagagtttagttttttttagttgggcttgactagatgttgcttcttgtatcccatttattattttatgcaatttttattttgcattgcgaattaacttattgttattttggatttttgagtatgaaattatggatgaacttttcttaatcaaataatattagttatatacatatatataatataattttaatttttttaatatagaccggctcaaaccaggccaattactggtccaccggttggatcactgacctactatctcaactaggtcaatagtcggaccgatttttataacattgattattttctttcgccgagtttatgttaattatctcttctttcgacctatcttttgattataattaaatcgaatattacaaaatacttaaatttgttcatcgatccaaattattttaattagagtttctccatatcaattacatgccaacatattttacatgatatcaagagatcctctccaataagttaaatgtatgttttcaaggtctaggcatgttcatttatttgcaacaaattaaagtaactttgaaatctcttttattagttacttgatacattttacaaataagacaacctagctcttacaatttcaaatgactagagtaatcaaataggccgtgtgatttgatataccgagttgcactactctttaattaaacaatacccaataataacaggagatgggagacaccttaataacacgtcattctcactcacagatgattatgctcctttaaggccacaagcatcaaggaagcaatagtgttctcggcatcattttttcgagatttttcatcccgtcatgtgaatgaaggatactgttgctatctgaacgacgcaaacatatcacagtgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactactaccttttacacataattcatttccttgcttttacccatgccatttccaccctctcttagcactgcaaaggactatactgcttaagagttcaatgcatgacacatgcaaaagaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtattttattatttcttgatagtgttggaagtgaataatatcttcagacccttctaaattgacatagaggattttgagggtgatcattcatagatcttttacagtaattatcaagattgaaataacagaccatcacatcacatgtacggcatcttcgttcacagcttgacaagtgcaaaccagagaagagaggagactctgaaggaccaaacctgaagcatatcatgcagtttgagatcattctgaagcacaattctgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcacagagtttcttctgtatcagcaacttcacctcacatcccttcatttcttgaatcttttctttaaatggacttggcaattcatcactgctactgctagcacctttcgtggacgtgccttcttcttcgctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcatattagagaagttttccttactctactctctctctctatacctctgtatatatatatatatatatccatgagtctagatatagtctctgtctaataaaaaaaattcagttttttttttggacgggaaaaaaaattgagatattgataactgaatcaatttaataagcactgcaaaaagtaaacaataaaaagtgaaaaaaaaagtattagattgaattgaattttaataatatttggataaatagccatattcgtattaaaagagcctattaagatatttatggatgaatttatgtattatatgaaataaaaatgattatttattaaaaatataatttaatctttatctttttaatgtaagaatattttattcaaaatagaagactcagatcaaaatacaaccattaaattaatccttacaaaacaaaaataaatctaacttgatactaatacattcaataatattaatagcatcttagcaatagattttaaactacacacacccaacaatctctaatcattgtgtaaaacgaaaaatttacgcaatcataaaaaagtcaagttagatccctcgaattgatcttcattactaatgtttgatcataaaaaaatttacacacccaacgtactaaaaaaaaattataatttattatcaatttagttcgtaacaaaatcataaaaaataaatatccctcaaattgatcttcattactaatgttaagttaactccaaggctatttacttgcatgtgagacatttttcttgcccccgtaagcattagttctttgaagcaaagttgacttttttaagataagaaaaaaaataaaatgttttgtttggtccacttaacatttgatattgcatgtgtaacaagattttatagttattatgacaaggacaaatgtgtgctgagatactttgatgtttaaatatatacaaattcgtgaatacatatatgtttgataaatgtgtcttatgattaaataataattttttaattcttatatcattatcttttggtctagttcctgttaattatctcttccttcagcctagcgtttgactataattaaattgaacagtacaaaatacataaatttgtttattgatccaaattgtttttaattgataatttacgtacattgttattatttataaatgtaacttttatttgagtttctttatatatggattacatgtctacatattttacttcatatcaggggatgctttccaataagttaatatgttttcaaggtctaggtagattcatttgtttgcaacaaattgaagtaactttgaaatctcttttattaattgttttttgatatattgatacattttacaaataaggcaacctagctctctcaatttcacgaacaaatgatcaaagtaatcaaataggcctcgtgatttcacataccaagtgaataacccaagtcccacatcgactagagatagtgccaagtcagagtatataagtggagaacaatcctcaccctaagagctagcttctgggattgagttaggttaaaatccaattacttaccgtagtcacaaatgacaaagcaactttcatcatattgaattatacaaagaatttaaaatttttccactattgcaatttaaaacctttattattaatcattaataaaacttataattaattatcatcatgattaattgattgcaacgaaatctaacaagtatttgagataaatatcattcattatcatcgtgatagattgataaacgtatgcaaggacctttgatgccttcactaatctggcatgcagcacagggccagggtaattcttttcggcaatagcatccacaaagcattccaattgctgaacaaggggaggggcactgtggcgaacgcagtggtgacggtgttgtttgtttataagatatattttatgaaattaataacatattcagataaaaaaaattaatttactagaatagaacattaaaaaataatttggattctcagttacggaaccattgatggtgatggatttaggagggcagacagtggtaccctattcacaggcaattagattgtgataccatatagaagaaaagaaagatctgaatttattgatgtataagtgaagtacgagtcagtttaatttgttaaataaacaactaaaggatatataacattgttatgcaacaaatgcatagagtttattttttgaattaaagataaactgaagaagtgcttgtagatattcagagatctagggagagctagttccaacaaacttcaactcacatcccttcatttcttgaatctttaatttcttcacatggccttgtaattcttggaatctccaacattattattagcactgctattgcaagcacctttggtggacgtgccttcttcttctctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcatattagaggtttcatttctctactctctctgtacctatatatgagtatacactaacctaacaaattttacaactaatcaaatatactaatttaaaaaatcaaagtggaaaaactggaatattaccaaatcatccgcagtatatataggtactatgagaataagtcttcttaaagaccagtaaatgatgcgaaattatcaagaaaaaatatatttatattctttcttattttataatcttctacctaattttttgagttgcattgaaattgaaatatttacaagattgtaattcgaatttagaaaatataatttaaatttcaaaaataatatgttttggtgatgtaaagttatagagtattttattttaaataataactttattcaaaacaaataaaacacgttaattttaatcaatcataagattttgtttttattggatttataattttaattttaagaatacaattttaagtaagattgataaatattactgtaattatcaaaagtttaaaattaaaatcacactataattataataacaattaataattttaaaaacaaaaattataaataaaaatttaaaattaagaaaaaatttctcaatgtgaaatcacatattgttcaaggcataacgtgtttaagaaataattgatttatttgaattatgtgctcgtttttataatttaaattatgtatacgtgattagactttttctcataaaaaattaatattactaatatactttataaaatatttttggcatatttttatgttggtaaaaaaatttattgtaaagaaaaaaaattgtagatttatttttttagtttatatatatttagttttgccaaaatttaggaagaagattagggaaaaaaagaaacaataccaaaattattttaatttgatgttctaatttttattttactagtatgtaagtccatgcaatgcacggggaattaataataatattattattgttttattttttaacataatatatcttttattaatatgtaaattttaaatgtgttttatcttagtacttattattaaaaaaagaactgagtcttaataatattagtgaaattgcagtaaaaaaatatattagtgaaaataagtatgactataggccataaagcattccacttgccgaacaagggtaggggcattgtggccaaacgcaagggtggaggtaagagacctggccgggttggagataggggtgaaagtgagccaggtcgtctatcaggggcctttggcctgacctatttaagggctgacctgacttatttactataaagattaagttcaggctttttaaaaagtctgtttaaataaaaaggtcagactcaaacttaaaaaaaaaatatgttaaatatatcaggctgacctatttattatatatatatatatatatatatatatatattaaaacttaaaatagtatatttatttttctaaaaatattttttcttattatgaaggtggatgattaatcacttcaaaagattatcttaaaatttcatatatatatatatatatatatatatggttgaagtgggtatttatcacatccctacgagcactttcgacccatttgcggaggcaaaagaaacagatgcccccggggcaaaagagtatgtgcatatccgcatacaacagaggaatgggaagaagagtctgaccacagtgcaagggctgaagaaagagttcagctacgagaagatcctcaaagacctcaagaaagagttttgctgtaatggcaatgttgtgcatgacaaggagcttggcaagattatccaactccaaggtgatcagcgcaagaacgtttctcacttcctcattcatgctcgccttgttaggaaggatcagatcaagattcatggtttctaaccaactaccactaccacctttcttgtattatgaaattaaacctatggctgcgtttatgaaataactaaggagtttgagtttggaatatttggtcattttctctctgtatgattgaaaatccaagaatagtctgagagttgttatatatattactacatgttgtgctatcatggaccatgttttaagctatttttatctgattttaatttttaattaagagtatcagtttaacaattctaaatttataagaccactataagttcaaacaaaataagttgttatatatgtgctaatatatatgaaataatgcgttgcctgcccttcaagaatcaagttaattttaagattagaaaagaaaagaatataaacaagaaccaaggctatttacttgcatgtgtgagtcatttctcttgcctcgtactcattagttctttgatgcaaggttgcctcttttgagataagaaaaaaactttaatacaatgttttttgtacatttggtctacttaacacttgatcgcatgtgttaacaagattttatagttattatgacaaaggaaaatgtgtgggagttactttgatgttttaatatgcacaaatccgtgaatacatgcatgtatgataaaattgtcttatatatgattaaataataatttatgaaattttacattattttcaatgttattgaaattggttcgaacctactggttgaaccggttgaactaggaacctagcatcaattgggctgagttggctaatgaatcggccatgcgtgtggcccagagaaaaccgttttgagaagaaccaaaaacctcgccggtttttaggacccagacagggttggtgaagaaaaaaaaaaggcttcagaagcccaaaatggcgtcgttttgatgccccaggaaaaaatgcttcagacgcataaaacccgaaaaaaagcttcaatttttcttcatcttaaattcttcatttgttcacggcttagttcaaggcctcaggcactcatgctcactgcagcagggcacgccatctccgttgttactagcttgtgtgggtgcgacgcggtgcagaacagtgatggaggaagtgagaatgacttcggacggagcaacgtcgacggcgacgaatcggaggaaatcgtcgtggagggagagagagaacaacctccaaatgtagagatgatcgaagagaagaatttggtgcaagggagaagcaggaagaaaaaattggtggacgggggcgctgcagcaatccaacatgagaagattatatacatatatatatatatatattgagagattagttttttttagatgggcttgactagatgttgcttcttgtatcccgtttattattttctacaatttttattttgcatttcgaattggcttattgttattttggatttttgagtatgaaattatgaatgaacttttcttaatcaaataatgttagttatatacatatataatataattttaatttttttaatatagactgggtcaaaccggaccaattacttgtccaccggttggaccactgacctactaacctactacctcagctgggacaatgaccggatcaatttttataacactgattattttctttcgccaaatttatgttaattatctcttcttttagcctatcttttgattataattaaatcgaatattacaaaatacttaaatttcttcatcgatccaaattattttaattagagtttctccatatcaattacatgccaacatattttacatgatatcaagagattctctccaataagttaaatgtatgttttcaaggtctaggcatgttcatttatttgcaacaaattaaagtaactttgaaatctcttttattagttactttgatacattttacaaataagacaacctagctcttacaatttcaaatgacttgagtaaccaaataggccgtgtgatttgatataccgagttgcactactctttaattaaacaatacccaataataacaggagatgggagacaccttaataacacgtcattctcactcacagatgattatgctcctttaaggccacaagcatcaaggaagcaatagtgttctcggcatcattttttcgagatttttcatcccgtcatgtgaatgaaggatactgttgctatctgaacaacgcaaacatatcacagtgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactactaccttttacacataattcatttccttgcttttacccatgccatttccaccctctcttagcactgcaaaggactatactgcttaagagttcaatgcatgacacatgcaaaagaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtattttattatttcttgaaagtgttggaagtgaatagtatcttcagacccttctaaattgacatagaggattttgagggtgatcattcatagatcttttacagtaattatcaagattgaaataacagaccatcacatcacatgtacggcatcttcgttcacagcttgacaagtgcaaaccagagaagagaggagactctgaaggaccaaacctgaagcatatcatgcagtttgagatcattctgaagcacaattctgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcagaaagtttcttctgtatcagcaacttcacctcacatcccttcatttcttgaatcttttctttaaatggacttggcaattcatcactgttactgctagcacctttcgtggacgtgccttcttcttcgctctttctttcttcttctctctttctttcttcttgtcttctgtggatgctattcaaaatctcagtgtcgtcatcctcgaggaacgaaaataaatgaggattcttttgttgttcctgtgtaagccaggcacggatacccttcctcagtatcttatcaatcgaatcaccttctttctttacagctcctcctgaattcttttcctcatttgccattgttatgtatctacgttgcagattagagaagttttccttactctactctctctctctctctctatacctctatatatatatccatgagtctagatgtagtctctgtctaataaaaaaattcagtttatttttttggacggaaaaaaaattgagatattgataactgaatcaatttaataaggactgcaaatagtaaacaataaaatttgaaaaaaaaagtattagattgaattgaattttaataatatttagataaataattattttcgttcgttatgaaaagattaattaagatattcatagatgaatttatcaatattatatgaaacaaaaataattatttatctaaaatataatttaatctttatcttgtaacaatattttattcaaaataaaaactcaaacaaaaatacataaccattaaattaatccttacaaaacaaaaataaatctactttaattttattactacctaatacatctaatacattcaataatattaatagcatgggagcaatagatttcaaactacacacccaacaatctctaatcattgtgtaaaacggaaaatttacacaatcataaaaaaatcaagttagatccctcgaattgatctttattactaatgtttgactataaaaaaatttacacatccaagtactaaaaaaatttataatttattatcattttagttcataacaaaatcataaaaaatagatatatatccctcgaattgatcttcattactaatgttaataagttaactccaaggctatttacttgcatgtgtgagacatttttcttgcccagtaagcattagttctttgaagcaaagttgacttttttgagataagaaaaaaataaaatgttttgtttggtccacttaacatttgatattgtatgtgtgtaacaagattttatagttattatgacaaggacaaatgtgtgctgagatactttgatgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttggcatcttcaacagccaaggtaccaccctcattggtgtatattgttagctccatattgatgggagacttcatattaacagaggggatagaacatccaattttatttaaggcatcctttgaaactttgaacttttgcaagatacttttgagcagaggtggaggacacaataagctccccgtttataaagagattagcaaagcaatacttaagtctccattccttgaatattttatatggcatgcatatatatctcaacatctggtgtcaccatcggctggaaaacatgcccagttacctaccatagtcacaaatgacaaagcaactttcatcatattgaattatacaaagaatttaaaaaatttcaactattgcaattgcaatttaaaacctttattattaatcactaataaaacttataattaattatcatcatgattaattgattgcaacgaaatctaacaagtatttgagataaatatgattcattatcatcttgatggattgataaacgtatgcaaggacctttgatgccttcactaatctggcatgcagcacagggtaattgtcttcggcaatagcatccacaaagcattccactgaacaaggggaggggaattgtggcgaacgcagtggtgacggtgttgtttgtttataagatacattttatgaaattaataacatattattcagattaaaaaaaataatttacttgaatagaacattaaaaaataatttggattctcgatcagttccggaaccattgatggtgatggatttaggagggcagacagtggtaccctatacacaggcaattaggttgtgataccatatagaagaaaagaatgatctgaatttattgatggataagtgaagtacgaggcagtttaatttgttacataaacaactaaaggatatataacattgttatgcaacagagttattgtttgaacataaagacaaatgcatagagtttattttttgaattaaagataaactgaagaagtgcttgtagatattcagagatctagggagagctagttccaacaaacttcacctcacatcccttcatttcttgaatctttaatttgttcacatggccttgtaattcttggaatctccaacattattattagcactgctattgcaagcacctttggtggacgtgccttcttcttctctctttcttgcttcttctctctttctttggtcttgtcttctgaggatgctattcaaaatctcagtgtcgtcatcctggaggaatgaaaataagtgaggattcttttgttgttcctgtgtaagccaggcacggatacccttcctcaaaaatatatcaaccgaatcaccttctttttttacagctcctcccgaattcttttcctcatttgccattgttatgtatctacgttgcatattagaggtttcatttctctactctctctcttacctatatataagtatacacaaacctaacaaattttacaactaatcaaaatataataatttaaaaaatcaaagcgaaaaaattggaatactatcaaatcatccgcagtatatacaggtattctgagaataagtcttcttaaagaccaatgattagtaaatgatgcgaaattttcaagcaaaattatatttatattctttttttttttataatcttctacctaatttttttgttgaattgcattgaaattgaaatatttacaagattgtaattcgaatttagaaaatataatttaaannnnnnnnnntagactttttcttataaaaatttaatattactaatatactttataaaatatttttggcatatttttatgttggtaaaaaaaattattgtaaagaacaaaattttgtagatttatttttttagtttatatatatttagctttcccaaaaattaggaagaagattaggaaaaaaaagaagaaacaataccaaaactatttttatttgatgttctaatttttattttactagtatgtaagtccatgcaatgcacggggaattaataataatattattattgttttattttttaacataatatatcttttattaatatgtaaatttttaaatgtgtttatcttagtacttattattaaaaaaaagaactataagtcttaataatattagtgaaattgcagtaaaaaatatattagtgaaaataagtatgactatagaccataaagcattccacttgccgaacaagggtaggggcattgttgccatgacgcaatggtggaggtaagagacctggccgggttggagatcaagctaagtggtgacttctaataaaagcaacttatcttgataattaatatccatttgacttttttttttaaatgtattttataaaataaattttatatattataattaaataccaaaattgtgtcatagtatataataaaatgtatttgttttaatatttatataaatgctatattaataatattaaatattctatcaacatgtcaagtataatttaattatataaagtcaaaattagtatatttctaattctaaatattgtattaatatacatttaaattttccttcatcttgaatggaattttttttttaataacattgtatttgaattttatacttaatatatttgttaatgttccattcaactaaattcttatttttttatccaaatatcttttttattttacataggatatatgatgaataaaatagtttaatagtcaattacataaatttcttttataatatcattaaatcatatcttattatcatgtacgataaattttaattttttataataattattttgaaagtcattccaaattgatttgtaattaaagaatactgtaaaattattttataatgtcagaccatcaaactcttctatcaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttattaaaaaggtttgacttagacttttttaataagtttttctaattaaaaagataagacttaaactttaaaaatagcttattaaacttaatagattggcttattcataatatatatatatatatatttaatatatgcataaaattattaatattaacattaataaaagcttgatacatttgttttctatttaggtttgttggcctagatttaaaaatattattttgatataaaagaaagacttttataatcaagattttatagtttaaattttattgaatttatataataagaatttaaaagatggcatataatattatgtatttataagatttgaaaggatttcatatatttttagaaaacatttaaaatcacaagagtcgtgaaaaaaactaatcaagaaatgttaatgtttagattaaacaaagtaaaaacaatacaattttttaataatcttttagtagctaattaattctaacttcatattcttcataatatatcatttcttcacatatctaaaactatactagtcctttatgtattatcatcttcttatccttactcttgcatttgaacaatagactcaaaaaattatggtcatcattatccagtaatactgaagatgaagatttgaatactagttcaattgaaaatatgacgggtgcactgttcagcgaacaacgatgcctgttgatcagagtgggtaaaacttcatttcttaaatttggagttcccaatacctatatacattagcttttgtctttttaactcaattttgacgatgtcgatgtatcataccatgggttagttgagttgtttttgttgtttgcaatccacgtgctttgaccccttgcaaggtgactagtcgtcggcatgcaaatatttgtcttttttctttttttctttcgaattttgacagatttgttttaccgtcattaacgaaaacatattgtgtttgttgctaaaacatatcttacatttgttttttttttcttctgaaaaaaaattaatgaagactccggaaccattatccttaaattaatgaaggagtactttatatgatttttatgtttcgatataataaatattaattttttcttacttttatttcctagacaagtatattcaggtgttaacattttccttttcagctagcagtgtttgttatcatatatacgacgtcacgcagagttcctactcctatatatatatatatatatgtgtgtgtgtgtgcaccaagctgtatatgataaaaaaaatactagcagttctagaaagcaagcaatttaaaatggaagatgtgaacacgcggaaaattaagcaaccaataatctaacacgttttgatactaataaaccatttgaccatataatgtgagagtttctctgaatgaaggcaacgcgtgaccctaaatattgataaacaaataaggaaaagatatttttgaagcggcaagccaaccttgaccatacattaattatagtggccgcaattaccagaactatatatacacaacggggtagcatcacataatcgtttgagagtaaatttgtattgtatatttctgatcattatattagttattattctcaatagctatgtacctctcaaacatcttcgggtgcttctccgagggctcaccagaagaatccaaaagatacacatgcgatggtaatgtttgtgttctgaaaaacccgaaggcaaacatggggaaaccacagacattatctaacagcaagaaatcaagacatagccttcggatttcgtttgctcgtcgtgccaaaaggtcttctagttgttagatatatatatatatatatatatatatatatatatatcactcttgtgaatggagagagagaggctcaggttctgcatgatgccatcagcccatcaacactacagggttacgttttattggtttcatatgtgattctttgatcgctttcatctgttgtacaacggcgtagcttattctatatcatttataaattctacctctagtaatcttaaattcttaaagatattttaacttttatttttaatgttcagttattaattaacaacttatagatctctcatatgctaccctgtttgtgatccttgtgaagtatactttaaagagacgggttgattttgtagcttaaaagctctttagtatatgtattgaatcaatataagagtttggaaaattctgttcgacttttctacttgattaagtaatgcttcttgtgtgagtgaatatatatatccatctagctattttaaatgttcatccggtatctcatttatttttatctttcttcctattgcatcataaatattcatcaaagatttttcttctgtatttatgtcacagaaacagttggtaatgtacattaatgttacaaaggatttgaaaattccaaaaatgaagatagagtagttacacatgagcattttcatcactccaaaatgccctgacagagagagctaaactgactttttttttttttttgtttacaaacgagaaaaaaggaaaacaaaaaacaaccaacaagcctaaatcattcttctaggaaacttaatccccaaagcatccaccataagactatcctttaacatctgtgtctgaggagcttcatgcaacagctgaagctgattcgtgcattgatttgcttcccaaaaccaatgctgagaccttaaagcaggaagtttaggatttgtttggcaagttagaagttcttttgaaaactttaattttctattggaaatataatatttttttttctttctcaaaaagacttctaaacttatatctaaacagactcccaatgctggattcctagcacaccaaataaaccacattatgatggggattagaattccctgcttgcaaatcggctccttcagagcatcaagaccgtcagggacatgcaactgaccaaatccgcggttgacaaagctattatttattcaattactttcaaaagccctaagttccactttaggggtgagagtgagacaagggatatgggaataagtaacgcaatggactaatgggtaacttctcgccaaatccatattaaacaaacaaacgtagcttaagtctatctgttaaacaagttagactattgttttaatttaaggtttatttagttcaaaaaattaaatcttaaatcatttaaaaaatctttcagacataataaatctgtgtatttgaatcataattataattatattaacatttcactgtgcgtgatatttaattttgatattttattcttgtttgtatgtttttttttaagtcttgctaatatatttaaaaacttaaactaattaatttacatataattttaagttcattagattatttaaagggaagattctaagctactttaaaaggttttattacaaaggagattttactaattaggatttctaggtcaaaattttaaaagattaggtcagatatttaaaatatctatattatataaataggttagactcggattttaggtttaaaaaatatattataatcaggttttataaatccttgtctaagacaactctttgctatccttaaaagtgactaaaaattattaaaaaatgatttaagtcaatcatcttccaatatatgtgaataaccacattatgtaattccaaccagacatgttacatacaagtgtgagcctgtttctcgtgagccgcattagatcgtacttttaaataagctaaactcatcaaatttcatatgatttaagttattaatctttataaataacttcatttggtcttaatcttaatttcaaataaattgttaattttaattcttatcaattttaatttttttaagatttgttcatattattttttaactatgacatagatataaatcatctagcatcaataattatgagataatatgtaatgcaacaaattaatgtcacattgtcactaaaatagtgataaaagtattttgaaaatgttaaaatttacaataactaaaacaattttagaatctttaaaaaaatagaaaataaaaaatgaaatagagtcatttatgagaactaattaagaaacataattttaaaccatcttaatattgagctcatttcaaataaatgcatgagacttagaaaaaaaaatttaatcataagtcatttcaaccttcgtatttccaaagaaaattaaaactaaataaagtcatttatgagaactgaggaacataatttaaccatttttatgtttagtttgtttcaaataaatgcatcaacttcgaacaactttttttaatcataagccacttcaaccttcatatttccatagtttgatacttctaataatcacaagctactccaacctccataatatttatgtcaacctagaaacaaatttacacccgaaacacccgaaacactagttccgaaggggtgtacagtactttacttaaatgttgaactagcagagtcgggtaaaattaaacaaggaaaagcaagttgaggttttgcattcgagacatgtacagaaaaatatagcagcattaagaactaaaaacaagtgatgccttccccatcaattcagataaacaagtaatcataatcaaatcaatatcaaggcaaccgaatttcaaccatttgtaaagaatgtagaaagcatcatcaacaggatttattgcccgctaattgaaaaatctaagtaacgcttgatcatgaacgactcctaaatgttttatatggtttcaactctaggatagaacacagacatgctgcattaactcggtagttctcatctggaaaagatggaaagtcttgaagttgttttctgccaaatctgctcaagtcttctgtggcgatcacaaatcctacttaagaaaaccatcataagattcccaacataagcatccaagggaaaacaatcttcccaagcacatggtattcatttcatctgttctaaaagtagcacaaggaaaacaattttttttttttttttttatgcatgcaagaaggtttttggatgaaattccacaaccagtcaatattcctgtggaagcatccacatcagaaatacaataattccatgtcatagttgccggtctggttgctgagagtcaaccagcacaccagatgattgttttgcaggtgacacaggagattgggaaccaatattcatgttacttggtaccatttctttgggctcatacactgctgcagctgtattattacttgtaagctttgcaactagacttgcattattctgatcactcgagggtaaagagttgaattccacttgtttcaaacccttgttctcataattgttgaggttcctggtttggacattgagctgctgataaaagagattgacatgagaattgggtcttggctcattagaaccaaacaaggatgatttttcatctgatgtaagcccactactagaacaagctgaaggctgttttccctcatccattggtccattaacagaatattgttccatggtggattccacattcttacaatttgtttcaacctctattaattcagtagtagactgcaacttagtcgctaaactaggttgtggctgggcatgattattaagcattaatactggggttggaagtggttcatactctccaacccaaccacgaccaaatttacagccaggtggcagtgcctgctgaatcttctgggaagcaactttccatgcagtaggtcccagagttgcagcaaaacgagccaaactcctggcatatgaatattcatcttgtggtccaacctggtgccgaaaaatacaacattaatgctttaaagaagaaagctaaactattcaaggattagaaataacaattcactccttttgatacatacactaactagccgtggcttaacttcaccctcaaatgttgtaaatatggaatccgatctagtagctggtagattagacatattatcttgcacagatggtttcctttccaagttggagagcagatccctccctgaaacaataaagtaacagtcaaaagcgaacagctagataatgacagtaatatccaactgagagtatgcaaagttgaacaacgaaggcatgaaatctatgaagcacatatacttcaatttgtttcacgtatccatatccgataccaatactctaaaatacttcatcgatacgtaccgaagaagtatccaaatctataaagcaccaacaattaatagtttaatttgcttcacatatctaatatcgatactctttctatactttaccgatatacttagtggtgaagtatccaagcttttaaagcattttatgaaagtccaatacaactacaagaaacatgtaagcgtgtataatatagaaacactttcccataatgaaccaaaaataaaaattgttctctttatgtatgattttaagaaaggaataagattcatagtattgttcctatattcaaaataatagaaagtaatttataatgacatgcaatcatttataattttatttttcattagagacatgtaagggaatttcaattaaattaaatggaatgaaagtttctcatcattcagaatttgtacaataattttttttactaatgttcaagaagtatgcttttaatttagtttgcaaaattataattatatatttatcatgtttatgaattttatatatgtatcttacacgtaatgtattatatattttttttttaaaataatcgtatcattgtatccgatacagtattgtttctgtgtatcatagcatgaaatagacatttcttctgtgatacctgatatatagttttctgctttctcttgatttgcatcaatcaataaagcattcccctccagaagggcatcaatattgccaggtctttcacatacaacaccttgcattggaagggaagttggcagtacatcaccaatagtagcacgagttgcacctgatgtaaaatcaaagccaacaggttcctgtgaagcatgacccagcggcctcttttctagcttcttaacaagggaattagatctccttttttgttcagacttcagttcactttgagaacattcagaatcaatccttaacttttcaaactttttccttgctagttcttgtattgatcgtgcctgtaacaaatatatagggatcatacagcaagcacaacaaaatttctacttgcgttaatttttcaagggaaagcagtcaattttatacctgtttgtggtatatggtctccgccacattgtattgcattgcatttgaggaaatcaaaaatacatcactctgcgttcaacaattgcattcaaatatttatttgcctttcaaaatcactaaatcaggaagacaatatactatgtacggtttaaaaatggttcagatgataataaggggtagcctaatgcacaacatttgaatggattgcggatattcagcagctgctttaatgcacaaggtttgcggatatataagtggttcaagatgcaaaggggtctttgacaaagggatccaatggaaccatttctctttcttgtagtggcataagggttgaattgattgatgatggaagctttaaaaatgggtctctaattggtaaagacaaggtggaggtcaacctattgtttttgggagaaacaaaattgaacatgtaattgacatcaagagcatcttgagatcttgagttagtattgggcttgaaagttaatttttccatgatttgctttggagctttaggcttgccaagagttgaagtggagagatttgcggatatcttgaattgtaggttcttgagagttccttgtgtacctcgacatgtcaattggcgctaatccaagaagacaagcaacttggagacctactgtggaaaagtatgaaaagaaactagtgggtggagccatatgatcctctcaatgacagatagagcttgcttaattaattttgttttttcatcattacctctttacttcttttccttatttaagatcccatgtggtgtattgaaaaaaatgtgtccatacaaagaaggttcctttggggcggaggggaaggtgataggaaaatatcttaggtgaaatgggatgagatatgtagagataaaaataaaggaggtttgggggtaaggtaccttggcacttctaatgtagcattactagcaaaatggaggtgcaatttataccaccaaaaaggcatgttgtggagcaatgtgatggagtcaaagtacagagcatggaaatatttactgaatgataattctttaagagagtattcgatttggtggaggaacattaaaaaagggtgtaggggtgagaagaaaggtaagtggtttgatagtatagtgagatggagggtgggagataggaaaaatactagattttagagggatacatgattaggtcgtgagtcattagctaataagtatcctaggctcttccatatttctaaccaacaagataggattgttgcaagtgttggaagatgggggtgaggtcagggagtggacgttcgagtggcatagagagtgctttgattaggagaaaccctctctggaacaattatatcaaaacttgaattcgatgtcgatgcaaagagaccaaccagacaggtgggaatggcctattaaggcaaaaagaatatattcaacaaagtctacctacaaatcattgcaggtagacaatggcaaggaccaatcagatgacatatggagatttatatggaacaccaatttaccaccaaaagatgtagtgatgatatggaggccatgttggatagattaccaacaaggcccaacctcttaaaaagagatgtgtggctatatagtaaaggaagaagcatcatgccctatttgcttagagaaattgaagtcaattgaacatttgttatttctcagtccaagggctcagtggtgatgggtacaatgttataagtggaaggatatctcaacagtggagtggttatttctttgaaggaggcaacaacaaaatgagtctttatatggtgtgcattgttgtggtgtacatggagatcccgtaataacatgatcttcaacgatgacattttttattcaaagaaaatcctataggaggtcatatatgtaagttggacatggttgaaacgcccacccactaaactcccatactcattacaagaatgggctagcaatgtgtatgcatgtttgggatgatcatataggaagggtgtttgagagatttttctcaagcaaggggataagttttacagaaactgaaagttgattatgaaatattgggtaatcattcattcaaatatgacataaccaactagatagccacttggatgttacttttctttagattatttacttatggtatatcttatacctctttgatcaatgaaatcatttatttgttgataaaaaatgcacaaggttcgaaaatcatactcctcaagggaaaaaaacaagctacatataacttatgctaaatttcatatgattcctataaatagtatactcccgcaaaatttccccactaatttcaatcaaaaacatccaaatcactaatgcctatacaattccattatcaacataagtgaataaatcttgacatactctattatactgacaagtaagccatttaaatgtttcccctcacacaaatagcatgcaacaacctcttgctctcaacccacataatcatattgcaaaaataaccaaaatatcagaaaagaaaaggaacatcccccaacttcaacagtaacaactgacccatttacacacctcaaattgttccaaggtagaataagatccatttgccaacttcttcctcactgtggcaaagtccatcggatgctcaatcactttgtgataatcaggaagctgcattcaaacataatttgaactttcatcttagattgccttccaaaagcaagattaacaattaacaggaagaaaagccctcatacctctttcggatccactggattcgcatacacaccatatatatctttcctgtcaattcaccaaaagacatggcatcgccatgcaacaataatagttgaagattgaagatgttatatagatcattcaccacaattaaaaccaaaaggaatgcatgaagaaagaaaatgggaaacaaagtcgccttacttctgaagcttgtcaaggataaactccaaggtcctcttgtcaggcaacggaatcccaggtggaagctttgatggagttcctaacactagaaacaaaaacaaaataaagaacctagttaagaaactcaagagaacaatgcaataaaacaaacaatggcacacttgtttcagtatccaacatggtacattgaaaaaaaagtagcaaattatgtaattaagaattacgaattacattacaaccaaaacaacaaaacacgcacacaaacctggaatagagcagagccctttagaatccacttttatgccatttacctatcacaagaaacccatacacacaaaataaacaacataacccaaaaccacaaaaaaaaggcaaatattgtgtttatgtaataaaaatatgcgatggagacagagacagagacaaagacaaacaacaatgggtcctaggttatctaatttatagtcatagagactagagagagatgtgggttaataaaatggaagcaaacacaatcagagagtctggatgtgtgtgttagttttttatagttgacccgttagttacttatttcccctaaattcccgacacaaagagagagatagtaaacataattcaattatggaccaattggtaccaaaaaaatgaggtagacattgtctcaaattttcaacgctttgtttagttacctcacgcttttcttcatactcatttgcttcctcattccctttttcttcttcttcttttccccccttttcatatgatgtgtgcaccccacgctcccctctgcgactcggctcatagtcatcctcatcattgtcttcttcattgttgttgagcttcacaatgagctttaacttcttcttgtgcctcttctcgtcctcttcttggtcctcgtcctcctcgttgaggtagtcaatgttgtagcacacattttgacggcgacgaagactccggcggaggtctggttgcgaggtggccaaagatttgtcggaacggcgagccagatctgccttggagggacgccccctcttcttcttccctacgatctgatccatcatttgttattgttgttgttgttgttgttgttgttattgcgttcttactcccactctctttatatctctccctaaaaccctatttgagtttctctctcttggtttgctttgggaggctccattattttcaatggtgcctgtgagatcctaacctagctgtcaccactcggacctcagctttggattacggtgggtgaggtaggctgcatgactttgagtgtctagttcccactatttccttcatttctttctctttcttcctttattactacaattaataataaataaactagtaaatacaattaatatcaataaattttttcttattttgtgtgtgtgaaatggcgctactggctaggaatgacgacatcttttgctactcatggcctgaaccctcatttgcatacctttttgcctgctgcctatatctctttgtcatttcctccttattttcaccaactatcacctcttgcagcatgtaaatcccacctcaacttaaaaattaattaattaattaattaacatgacaaattggattaatgactactgcattggcttttctcgaggatctcgatgaggtccgagcctgactgtcaccactcgaacctcagcttcagattacgatgggtgaggtaagttgcgggactttagtgtctagttttacctgtttctttcatttctttctctttcttcctttattactataattaataatgaataaactagtaaatacaattaatatcaataaatgttttcttattttgtgtgtgaaatggcgttactggctaggaatgacgacatcttttgctactcatggcttgaactctcctttgcatacctctttgccagttgcccatatctctttgtcatttccttcttatttttttcaccaactatcacctcttgcggcatgtaaatcccacctcaacttaaaattaattaattaattaacatgacaaattggattaatgactattgcattggcttttctcgagaagctcagtgaggctcgagcctgattgttaccactcgaagctcagcttcggattacgatgagtgaggtaagttgtgtgactttgagtgtctaattttccatatttctttaatttctttctctttcttcctttattactataattagtaatgaataaactagtaaatataattaatatcaataaacgttttcttattttgcgtgtgtgaaaccgcattacaggctgggaatgacggcatctgctgcccgtgcccgaaaccgtccctcgcatgcctctttgcctgttgttcgcatctttttgtcatttcccccttattttcgacaactatcacctcttacagcaagtaaatctcacctcaacttaaaagttaattaattaattaatatgacaaattggattaatgactactgtactagagggagggaataaaatactcctatatagtaatgcagattttttagttattacaatggagaattttaagggaaaggttatgatgattttcttaatctattttgtgatgattattaggttcatgaaattggagtgagttagtactcctttgtccaacttttgcatctattaattgactttccttaatttttgtctctctttccaggatttaaataggaatacataatcttgatgaatatcttattcccatcaattcattgaataagacttttttaagtctttttaataaattccgtagagtaacgctttgatatgtgttttaaaatttaaaggtttaaatcattttttagtatttttaatttagcattttttttgttgccgttaaaaaaatgattccaatccttataaattatgatttttttttcatttttatgtggtttagataatatttttactgttcaaagagttatataaattactttaaagataaaaaataaaataagcataatttgtaagaattaaaatttaaaaaattacaaggaaaaaaagtaaagaaatacattaaattgcaataacaaaagatatttaatccaaatttaaattatgcatgtatatttgcaagctttaaaaaggggttgcatacaagttattgattctcctttttaacccgacatgttcttttgattacaggcttttgttttttcttttttattatttttttgtctcaaagctttcacacattttatttctcatgtaaatcacataaattttaaaataagtgactataagtaatgttacctacaacacacaatacaaaaatcaaccacgaaaacaagttcataataataactcaatatttttgtgaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttttgtttgacgagtctcatagtcttggtctccgaatattaattatatttctttgtttcacgactattgcaatcaaactacttgtgaattttattaagagcaaattattactcaaatttcacatgcattttctctctcattttacattactttggcctcctttaacactattaattagtgtcattttttttcaaacccataaaagtccatctcctctacttccaacacaaacctaatcctcatcccaatcctcatttttgtatatcattttttttaaaatgatcagaatatttaataaaactacataattctattttttacacaaatataagtacatgtttaaaacttaaatttaggacaactaaaatctacttggtttgagtgtttatttttttttttcattttcaaaatttcaagatttagaaaatatatatcgagaaaaaaactaaattttcacttctttaaaaaaatgttaaaaacattaatttattgttttcagttttaggtctatttttgaaaatattttttaaattttaagtaaacatattttcactcttatatttgatttctttaaaaataaaaacaaaaaacactactcaaacaagtgccttgtaattgagttaaaataatctcacttttggttttcatgcttgatgatgtactcccggtacttgtccaaatcttagtgacccccttctaatttttatttcagattcggatttcctatattcaagaatttgacacattcaatcaatcacaatcgtgaatggttaaacaagttatattttatatcaaacttaaaatttaaactgtccaatctctgtctgactacatggattcattgtatgaatgtatggcatccttttatttcatagattattcctttctcaattcgaaacttctgccgagtttgtaatcgatgtcctcatatatatatttgtctcaaatctcaatcatgattcaagaagcaggcacagaattaaagaacgccaaaatgtcaatattatagtagtatatacgcatatttgtacgagtatgtataatgtaatagttaatcgtaagtcgtgattgaccgtaagtatatgtctctactcgttagttttttggggggttactacttaagccttacaagtacctgttaagtaggaaaagttgtagtgtattcttcttgaaagcctacatgatgaacaaagctacattaacttcgaaaaatagttgtgtgcatgtaatgtgacatggttaacatataaatatttttaaatatgtgattagggtttaattttagactggtgcttaattacaagaaaaacatgtgttagaagatgtcaactccataagtagatttataataccttcagagattatattttttttaataactggcggccaaaaaatattcggattaaagaaaaaagttgttcctatttagataaacgggcttttatgcggtatatatcaggttttttttttttttttgtaaaccaaagaaatgattatataaataaagtggtatatataagaaaaaaaaaatgttgagtttcaaagtggggatatgatgtatgttgtgtgtgacgttgaaaacttgaaagagtctgaaaacaaaacgtaacttgagcggagccaccgtatatacgtcgggacggtcatgttctcttgtggttgtggaacatgaataatttctttaattaaaaacttgcacataattaaatatttttaagaaaataagcatcagtttctatttggaccaaaaaaaagctttaaaaagtgtctgtgtgtgaatattgtacccttcttgctaaatgctagtccttttgcgtccaataaacattaatttatttctctgtcaaattgttagtgaagctcctaaaatgtaatattttatttgaacggataaacaccatgtgaagacgaataaatcacatatcacatactattttttttttcctttgagtgtcagagaatggtgtttttttttttttttctctccttaaattgtaaagggatcatggaggtctgtggaatatatacagagagagagagggtttaatttatattttgttattttaattttacactagcatttattgaatattgattttattgtcacatcataagacttatgacgaaggaaaatgattaaaccatattagttagaaatagatgtttacataaattaaattatctctcacatgcacgcacatatacacacatttcaagatagatcaaattattttaagaataatttttaataaaattacttatttcaatatatttttctgtatctattaaattttattaatccaaccaaagatcctgatgttgtcgaagttctggcttaaaaagatttgggttcagaaaactgtcttcagtgtcttttatcaaatgccacacaaagatgacttggaatgaaaggaactttattaagctccttgtttccttagaatttctactaaagtaacaaaatcatgatatatatgaacatagagaagtggaaagaatatatggggcggcaaaagtgcaatgaatgcgaatcacaagtctattttagctcatcaaaatttatatatatgaatgaatgccggattgaatttggagagtgatttatagtgggatgaagcatatatgttgcaagctgacttccattgtgtcaaggtgatattgtgtgaaaaattgaaattcttatataatttatattcagcagtgctttcaaagccaaaatattggggggaccactgtggaccttaaacgtgtactactgtacactttatgaacatgagggtttgacctagctttaaaagctttaagttcaaagcattaattatttatataaaagtattatatatatatatatatatatatatatatatatatagaaccttttactttgagctgaatgaggcttttacttgtcggatgttgcgtattttgatgtggctacctctgatagctttatatacaacccatctactttattaaatcataaagaacagttgagcaatactatatagtaattgttttcgaagttcatcagttggttcttttttggtcattcaattagatatagggtgccacgtgatgcatgtatgatgtatcgatctgtgccttcgaaagttcattaatcagcaacatcgatcagattaattataaactaactaaatttaattaaaagttatagttgtgcctagctagttgggtaattatcaaaaacaggcctaattaactttgtcacagtttagttgttgagggaattaacactaaaaaccaaggcaacaagtttaagaattttacttttgacgttgacaatgtttgtcccattaacatatgacacatcatattgacaataaaataagtggatggagtatctggaaaatactctttgctccactatctctcactagcattcaatcaaatttatcttttcacacgtaacgtgtacctttcatccagctttgtggtatctttaaatatcaatcatctaacagttgtctacctccaaacacaccctacaccaaaaacaatttggagcacacacaaacaaacccaccaagatgggtaaaagagctttccttattgtccatgccttcttcgtcttattcagctttggttcctcaaaggctgaaatggtttctgccgtttatgtgtttggagactcacttgttgacgtgggcaacaacaattacttgactctttccattgctaaggcaaatcatcgtcactatggtgttgattttcctacacacaaaccaactgggagatttagcaacggcaagaatgctgcagattttgttggtaagtgaatccaaattcactctagctattaatatgccacttcaaacagttgtatagaatatagagacattttttaatagaatgattgtgtgggttgcagctgagaaattgggtttgccaacttcaccaccttacctgtcccttataacatcaaaggccaacaaaaacaatgcatccttcatggatggtgttagctttgcctctgcaggtgctggaatatttgatggtacaaacgaacgttatgtaagtgaccaaatgtagttacctctttccctttaattttttattacctccaggcttttttaaaatttatttatttatttattctgtttatgcaatatatgggccaaattaaatagggatatgtgaatctgacccaagatgagcatggatgttttggatccatctctcaaccaatgttattagattcagactgattattgactcgatcaagatattgggttaccaagttacggatcaatctaatgagttatcagttgactcgcatgatccgatttatattttaaaaaaaatcaaaataatttcataacatgtaaacttgtatacttaggatttaaaatttaataaaattcattatatttaaaaatagttatcattttatttaaaattttgagcatacaacatatctttttcataattcaatatatataaacaaccttaaattagaatttaatttacacaaattactcaaggaaaatttgcaaatggtaacaattttatcacttaaaatttctaatatgagtgatgttgttcgattgggaaaaaaactaaaaaatgcatgatccgccgagttcgagtcactgattcgagaacatgcttagtcagattgaacacaccatatcacatgcatataactgatccaacccaacaagtgacacataatttctaggaaagtcgattcctaggaattataattcttagacatgtgtaaaatacatatagttggttttaacatgtttcttggaaattaaagattcatgtaaaataagtaactaaaacttttcctcacatcaggaaattatttgtattcttacccctccttgggaattttttttgcggaaaagtgagttaaaaatataatttcctgataatctttttttattaattacattccaaacataaaaatcataatttgtcactttaagattccttcaaaaataaatacttttcatctaccataaacctcttaggcacattattaaaaatgaatgataatcatatatattcactttcttctttatatcattttaatcctattttctttattcattaattatttttgtaattattattttctctatctaccctttctatttttttctttttttcttttttggctctaataaaccccaaattaaggtatacctttatcattactcatgatatatatatatatatatatatatatatatataaatatataaggagaaattcacttactttaaaagtaattcttttaaggttattctttattttcattattcataatcttaatcattagattttaagaaaatcaacaatcaaaagtaatactactcttaaattaagtgaattccctctatatatatataatgttccataaaaatcgttactctcccaactgagccaccccttattctaatgttctatatattgttggtataatagtgtacttaataacaatatatattattatatatcatttcagagacaatcaataccgttgagaaaacaagtggactactactcaattgtgcatgaggaaatgactcgagaagtaggaggagcagctggtctacagaagcatctctcaaaatcaatcttcgttgtggtgattggcagcaatgatatatttggatactttgaatcatcggatcttcgtaagaaaagcaccccgcaacagtatgtggattccatggctttctcactaaaagtgcaactacaggtaacacataacatcacatgaacatgcttataatcaagttactatgctaccaatcttcattaatcactgatcaatagatagacttgctttacttttacctacccatcacatcaaacttcaaaaaatttgtaccgttgacttaataattatattgcggggttccaaattccaatacatgcaccctatttgcatgcatgttactttcttgtaaatgttctattgtgcttagagggtcaactcttgtgtcattatttaatttgtcgtcttctttttttcggtaactttttttaatttttttttttttttgcagcgattatacgatcatggtgctcgcaaatttgagattgcgggagttgggacacttggatgctgccctgatttcaggctgaagaacaaatcggaatgctttatagaagccaatgacatggcggtaaaatataatgaaggccttcagtccatgttgaaggaatggcaatcggagaatggaagcataatctactcctattttgacacttttgctgccatcaacgaccttattcagactccagcttcctacggtactattttttacaataacatatccaaatattattgtctttcttttcatttctttattaagaaacttccttctcttttattttttttatccttttaattcaaaaaacttaaaaatttattcactttttttctcttttatttctttcttccatatttctttcctctaccaaaccatgtttattagttttgttttgagtaaatgaccaatatttattctctaaatttgtatttcgttatagttttaatcctaaaagtaaataaaaaccaaataagttcgtgaatgtttttaatgtttcacttgggtctctaaaaataattttttttttctcatttttgtctctaatattatgttgttattagtagtattacttaagttccccatactagagacccaaaatgaaaaaaaaaaaagaaaaagagagatttatttcaaagacttatttaagttttccttaatttcaagactaaaatgataggaagatagaaattcagaaaataaattggctatttactcttttgtttttataaagttggattctaattaaaataagtttaaataatcactttcaggatttagtgaggtaaaaggtgcttgttgtggactgggtgagctgaatgccagagctccctgcctgccattgtcaaacctttgtcctaacaggcaagatcacatcttctttgaccaattccatcctacggaggcagctgctcgtttatttgttaataaactttttgatggcccttcaacttacacatctcccattaatatgagacagctagtagctgcctagctgaagttgacgattgattttagcccttcaatgacatttttttcatctaactcaatatcaaatgccaagtgtgtggtgttgggacgaaaaaaatactactagattcgttaccccgtagagtaatctatgtaggcttcatgaaaagtgatcactggctagccaagtgtattattttacttgaagtagatgatatactaagattggcataacatgagatatatgaaggtgtatccatgacaagatgcattcgtgtaagaaagttgtttttttattactcgtttaattgcaccggtgcaattaaacgatgaaatgatcaacaacactatcatttatgttatctgaccaagtagctatagtgataactgataacttatgttgataaggtgacaagatccaactgattcaaggtcaagagttgatgtgaatccaagctgtgacaaaccgaaagaaggaaaggaaagagaaacggtgtggtaaaacatattaataatcaaaattattagaattttctaaaaattattatgagcaagggcaacaattaattgtggatttttagctgagaaaaacgagttaatgtttaaatcattttaaagatacttgataatatatttatttttttgctggataaaaggggctaaagcccaataaagcagaaactaaggaacagacagaccagctgcatcaacacgcagcaaagaggaaataaacgcaggagcaacattaaaagcagaaaacaaagctgaagagagaaaactctcttagccatctcatcagcaacccggttgtgttctctaaacacgcttctgaaacagcaacccacaggaattctggacatcctctgaatggtttgcactctctcgagaagaagatggctaataagagacaaagtagagcagagacgaacagcttcagccgcatctgattccactaagacgtgcgagtaacctctatccaaagctagctgaaggccattgaggatagcccaaagtttggcttctaggacataacaagttccaatgtttgccataaaaccatgcaaaaagacaccataatcatcacgcagaactcctccgcaaacagcctcgttatcagacattctaacagcagcatcaacattaactttgatccaacctaacccaggcgttatccaccctaaagtagatgtcggaacggttgggtcagtatgcaaagagaaatcttcgaggaaactaatagtaactaggatgcttgataatttagcaatataaagaaccacttacaaggaacttatttttaatttatttgaacttattatgatatgttcataagttctttttatttttttatttcaataaattcttcaaaataatatgaaatgaacttcaacttaattttctcttcaatataaaaacaacttatacataataaatattattctataagtctctaattaaactatttaccaaaatggaccctaagtttgtaaaagacttaaaataaaacacggattcaactcgtcttgacataaatgtcatgatcacatatggcatctcaataattcctacgaaaacaaccagcagaagacttcagttcatgtcacgatgcattaagaactagagaaaatacatcctcaaagaaaagttttaagtcgcctttgtcaatatcatattccaacaatttctccatggcatcctgcattccattcagaaatataatttaacatgtctctgagagagtaaacaatatccaaagctgtaatttggttcttgaaaattgatatgacaccttgtattgacgatcttgagcagagatgttctcaatgcataaccgctgaacatgtttattatgagaaattcttaggtacacctggagcaagacgtgttgctctgatccatttattgttcgccatgtcagcattatgggtcattgttgtttcctaaattaatgccaattttttatttttctaggtagattaatgaaaatttttaatttttttaggtaaattactgacatggtgaataatgaatagatcaaagcaataagatgtcttgctccaggtgtatctaagaatttctcgtttattatttgaaacggtatccaacacagctgttgctctttttatgatttcctctggtacacctgcatgaaccgtacagcttgttctaataaaataaataagagcagaacataaaatatgctttatacatttttgttatcagctaaaaggaaagaaagaatcgaacaatatgcgtagtgtactcttttgatcaggaaatatcatttttaaacagcagttttgtaaattaccagcaagcagtgcacagtgcagccctgcaggattccaaaaaccacacatcattttcatcagtgtttcaattgatataacaaaaaatgttagtaatatactaatccacactttgaaaaacacttgctgaaatttatttaaacttaactcactaaatgatgtattaaaaatgcgttgttaatatttctctttactgtgttcgaaagtgttttattaatgctcatgatataaaatactgataaaacaaaagcataccatagctatgatgcgcatgcccagggacaagcctgtgaggaatatgatccacagatatcaaaaccacttcaattctatactaatctcaatagtccagacaaagtacaaggaaatctcctctgcacagtgcattgcatgaaccaaatactatcattcatgtcatgtgcagattataatgtatcaggataagctaactgaaacagatgcatgattaaatgtgtaaattttggcattcagttttccatctcccgagtctaactaaaaatgtttttgtttattacgttttatatatatatatatatatatatatatatatatatatatatttgttaaattgtctgatcaagtgaaggtgaagtacaatagcattcctaattcagtaattcctatcaaattctttgacatcaaatgaccttatgacgataaatataattcttagcatactgcatggctgaatcaacaataaagatacctgtataaaaatacaatgtcttcaatatgtgtggaattttcgtcgggcctcagtatactcattgtgtaaatcttaatctgctcagactgaaatagtccaaaggaatcaatgttgatgatcactcaactgaggagttcaaacactttccacaatgatgcacaagtataagtacataaccttggtcaaggaatgcacatgcaataaatccatgagatgaatgcacacaaaaacctacaaaatttacagaataaatgacagttacaatctctcggagaaactgcatatagtcacttcaccagtttgcgcttatacatttcgattacaatttgagtctagggtctgagttaatagttagtgattagtacttcctcttaataaaatttccagggaaattgtatttcaataacaatgtcctagaaaactgatgcttgagagcgtaaaaaaactgttattttttaatttcaacaaagataaaggaatgaacttttaacttctactctcatgattaatgaacattaattagttcgtaaatatttaatcaaatagaacgatccttaaccaattaactaatagaaataacaaaatcaaacttgtaaagggatcagacacttataagtttatagacttgacccgaggacaactggaagcataaagatgttcatcacaggaaaatgctgtgaagaaattaaaagcaggctgtgaagaaaatgataattcctgaaaagttgaattaaaacatatatattacacattttccggaaaagaagtcttaaacctttgaaggttcatcagtcgtgacaaagtgagttatggtcccagcaagtagaccaattccatctgaaaggaagatcaaaacatttatggtaaaaactagcatctgcaggacacacacattccatgtatttatgatttagacacttaataaacattggattaacagaccttctgtaagagtgcctttaccaaattcatccaccagacacagagaacgtgaagtagcatgcctgcaggtttcctcaacattaaaagaaaaaattaacacaccccaacccacacacacatatacagttatacacacactcttcttttaataaactacaaatctcctggaaccctacatctatttaattgttcagataaaaccattcagaaaaacatctgcaattataaaacaagtgggtttaattatttattttatctttatacatgcatcaacttttcattttagtctctacctaaaaattgtccgtataaaaaattctctgttttagtccctattggaacaatttttttatgttttaattcatgttgttcgttttctggtagtgtaaaaccatcacaaaatggaggaataagactaaaacttaaaaaaattccttgtatagggactaaatgtaaagtttttaggtatagggacttaaacgaaaggttggcatggatatagagaccaaatgattaattaaaccaaataagtgagtaatatggaagacaggagcatcctgcatgatattctaaatactgggaggttatacagattttgcctatgatcgatatatattcaatgtattggagatatccttattagcctttatcttggtatacctgagcatcatccctatttgatgtagatcaatcataaatgttgattgttcagctgccataagccggcttcctgttgcacaaaatattccccccctccccaccaaaggaaaaaaaattacaattgtaaaactaagatcagcatacaacaatgtaactcccatttcacaaaggacacgattcataagaaaatgatacctatctgtcagacccacagttgctgcatcagctggcacaaaactgccaatgtgggagagaaaaacaattatagcaacctgcaaaatacttctcattacattatgatcatagagcaacaaggagcaaggttgtagcatcatgtaatagccacacattagactgtatgttaaggaatcaacaatctgatgaactgtaatgtggaagccaaaaatttttagtcttcaagacagtccctcacaaaaatcctttgctctggaaaggtggataaacaagagctcatcacataaaacaatacaaatgttaagatttttaatttatttatagtctgtcattttaccgtaaggtaatcatacaacaacaaaataatataagaaatgttaaaaattgtttaactttaatattgagtacaataaatttatattattattaaattgtgatgtcaattgtcatgtagtaaatttgatatattcttgtatttatcaaataatataataatatgttattaaataataataatataaagtaattgttatcccaaaaatacatggtaattaaattctttttcaattggataacagaaaaaattgttacgagtgaatatcaaaaaataaaaacatgcaaaacccaaatcaagacagaccagataaatattaacaattgtagtttgtaggttgtcagaccagatgaatattaacaaccagaagttgataacttgatacacgtactgctaaagaatagttctgcaacacttttttcatttagagactagaatttagaaacattctttttggagactagaaggtaatgtcatagaatgaccttttcaacataattgctatttaaaacagtatgatcaaatcatacagaatacatataccagaaagataaagaactaataactgacctgctttagatagatactttttccagaaaaattaggaccagtgatgatattaattcttcctaatgtaaagaacaacggatcagggattaataacaatataatgtcatcaaaatggatttcaatgatataagttagcaattatcagttatgtatgtctacatctatttaccatcatgaagaatcttagtgtcattaggaataaatgtgtctacagtcatttcctgcaaaacatgcctacaaacaaaaccagtttttatcattaagcatatcaatgattctccatttccaagaggttcttataaactagatggtttgaaccttccattttttatatcaagcaaattttcttcagtcaacgaaggcctgacataattgttctgccgtgcaaccaatgccattgacaaaaagctgaaataaaattatcaatgataaaaaaaatgtctgagcaagcaccagttattataatgacaaaatatatcttaccagtccagttcagctgcaaaagttgccacctttatcaaataggtttggaacaacaatatacgtgaaaacaagtctctggtgatcgccctctccatatcttgaataaaacaattcgcaaataagtaagatttgcaccagagaccaagtgttataatttgaatttaggaagaaaataactacctacatcacatagctcttataacacttaagctgtgtcaaggaatttcatatttttttattaaactctaatttcttacaactctacacgtaatattacatctttatagagtgtgcctgtttctccattatcctgctttcaaatgcacctcaacatgactaaaccaaagtcatggattggcattcaactggattttaagtggagtttttccatttcaaggttagagcatgttacaagtctgggcaaaggctcagctacttacttcaaagtaaataaataaataacaatagggaaccatcaaatgtatgcttaaaatacctagaattttatggtggatatctcccagcagactgtccaattctcgtgtctttggcgttctataaaagtatttttttgtttctccatctgtatcacaaaactgtaattgaaatgactaccatcagaatataacattaattatgtaaatcacttgaccaattgcaaacggcaacatactgtgtattcccaatctacaagttgctccagagtggtttcatcgggtttttctccaaagatacacattaaatatcctacagtagaaagatatgcattgtgcaataataaaatatccagtattgtttaacatccgaaaaacaaattgcaatgaaaaaataaatatgaattagtgttgttaaacagccacaatggcagcagggcagtgccaccctgccaaggcgtggcagaaatccagcaaatcactgtgtgggacacttggagttgaggattccttgtggtggcaaatggtggctgcaagatcatgacaacatcaacatggtggtccatggcgttttgtaaaggacacttttgttgtctccgagaaatcagaaaagggatatctaaaaagcccagcatcttccggcggtttcctctggcaatttacggttccttcttcagcaacttgctggcgactggaccttcacctcaggctctgcatgttcatctctctgattttcccagtctcaggtttgcctttgtcactgttctctattccctgtttttgtctactatgttccctgcgttccctcactgttttcactgtccttgtctattatgttccctgcctttgtcactgttcattctctgtttttgttatacatatggcttcattgatttttgtctttctggttttgtatgatgacaagatttcaacttacaatctcatccaaattatacaaaccttccataactgtatgttagtgttgtttttcacaaattttattttttttaaataatctttttacaagtcacttcaacaatgactgatgtgaggataactagagacgttaatgggggcaagaattgacctatcatgaaagttatcggttcgagacatgtatatatcattatttgaaaaaatatattttaatttttttaaaaaaaaaatttacttaaaaaaaaatttacttagatacgacgaatgtgtaagaaacttaatgcgagaacacttttttcatttaaaattttggaattatgtattaaattttggaataatatataaagactatcccttaaatgtatgacacattattaaaagtgataatatatgaattattttcaaaatttatatttgacccaaaattttatattaaattttacttataataaattgatattataataaaaatatttaaacattaaacatataaatcaatctaatccattctactcaaccgtgaatgcttgttttgttttttctttatcatgtatggtagcacaagtttggactgcaggaaaggacagaccggcatgcatttcgagaaaacgaatttaggatgggtttcgtagaaaggaaagaagaaaaaaagtaataaaggtctaaaattcatactaatttattaatttattttttcattttctctactaaatccacccttaaaagaccgggcagagtgatttaatgcaattggcaattgccacggactcgtagtatataacggaacggaccaatattataacttggatccccgttttggtttgggttatttgagtgcagaggagagtgaatttgtgatgttccgctactactaatactagttgatatcaattatgaaaccgtgttggtcttcttccagtccatctagtcttggcatggcatgactctcagcgtttcaatcctgacctcatcatcttcgcgtgttgtggcttaacgtgcgcaggaaatggaggaggagcagcacacttttgtgtccaaagccagaaccgcctttcattccgccgcggccaaagcggagcgcgttctcttggatttcaaatccgatccaggttctcctcgcgccacgtcaatcactatctctctatttttagttttcctttttctccttatattccgaacggatgtgcattttttttgttttttttttcttctccctttctcttttagggagattcaaacaaaaaaataatttaaaaaataaaataaaaataattattattattattattgttttcggaattagcattgactcaatttgttgaccgtgaagaagatcacgataagcagtcgtcgcccaaccccttcactggccaacaaccagaagctgaatctcctcacaccgacgaaaacgactccaaggtaatggcaattatttatttggaagaggaaacattgaacttaactatttcaatcctaccgaggttcgattcgttgttgttttgttttgttgcgttttttttgttttgtttttattcccaacgtatatgcacttccgggagctgtatttgattatcaaacaaaagtatatttgtttcgtgagtttctaatttgaggttaataaggaagggaaatttagatcagggtgttgaaattcattgtttggtgaatctaatgaactctgtttcttatttaatccgttccctcaatgacttcctcaaaaaaaaaaaaaatcacaattaattgtgaaaatatttgcaggagtcctgcaaagtgaatagttataatttcgaaatgagtcttggcttaaagatggtcgaaaactgtttatatgtttttgtttgcgtttatgtctaggtgtttattacgtgacatttgtcctgtaattacttacttacacaattggtctttgtaatgggatggtgcagcttcatagtgaatcgaagcatataaagtggaggcctccacatttaggaataaagcaggattggcaagataaaataaagaacatccggagagggagaaaagaagttgaagatacagataaagttggggatgcaagcatggccattccattttatgatgataatttgtacctcctgaatgtaaagaatgatctcgaggccaaggtaagaaaatctgaaacattttaactcaaggattcatcttccaactgcgtgcgtatgattgaagtctctaaaccaggaagttaagtcaggaggatgttagcaaaatctgatcatgtatgctgactatgagcattttgttttcaaaatagtctgtcagattgtgtcttcatcctttgtctagtaagttagcaatgcttggtatgcttgtgataaattggtaatgcatgcttattaggtatctcatggtgtccctctttccagtaaaatctttgaagatacaattgagatttcttattgatttgcctatcaattatataaatgagtatcttattgatttgccaattcagttacacatatgggttgctttaatgatgtatgagtaaaaactttgattcaggcttcagaagcaattccctcagttgaaggcctaactgctgcaactaaagaccccattcctccatcatctgtgctgaagcaattggctatagctgttgagtaagttgtaattgtttttgaatatattttttgcattctgttgtcccgttttcctgccgctttttgtgaactactgaaaggttctattcaatgatgttgcattctatttctcgggttgcaaagttcccccacatatttgtcaaatgcaatagttcaacaacataagagtcttgttctatcattcagaaagatttctgctcaacaatatatctagcctcttccttaaaatttttttacctcttgactagggctggatgtaaagcaaagtcaatgaaagattttatagcttcatcaggaggttcttcacctgctagagagagggcaggcttaagtctcttggcagttaaggctttagtgctacgtgaaaaggaggacaaacttacatctgagtttactagcaataagaaagttgtgcagttaattaattctctgtttgatcctggtatgtgaattgtaggtggcttgctgataatgtaattatgttaaagaacgttttaatgcttgtcctcattttccttaacccattatctgttatgatctttcactttcgttgtaatatttgcaagatattcgcagaaggagatttccttagaagaaagatcgactctaatctagaggaaagtgctatgacatctttgccaagagatattcatggtgcgcctcccgaaagccttgttgttaagctagctgaaatccttggaaactacaagactcttcgaaaaatggctcttttctggtgcggggttgttgctgaagtatgtttaacttgaaaagaacttatagttctgatatcatgatcatacatcttattacttacccagaactctagatttaatttacattattgatcaatttttctgttatatataaacaattatctgaagtaactgtcagtttaagtgattatgatcttagtaatagagtgcatcatcatcattgatatcttcatcttagatcacgtgatttggccaaataaatatgcaagaccacttgatgatgccatgttaataaatgtcaaattttgtttcctacttgttttgatttttaatagttattttaaaggtttgagaacctcattttgtttgagcagttgggtagtgaattttttttccttgttttatgctgcttcttttttcttttctttttttaaattctggtctattaaagtttgcatccaattttatccttcccttcccctttgcaaaataaaatttgtggaaaaggaagcaaattattcatatgctgtgttattggaaactttgaaggctttcaaaccaaaacaacagaatccctcgtgtactgtaaagttgtttgtctttcttttcctcctcaaatctgtttgtctataaaagaaaaaaaaaatcatatacaaacttcttctggtttaggatctgtaacttgaacttaactagaatcactaatcctatgtttccttaattaccagctgaagaagaatattttaaacttaattagttattttactgatacagctaaggaaactttggtttgaggaacaatacttaccaggagtcccccagaatgagattcctgatctgaagtcatgtcttctatatcaacaatttcaagtaattaattgctgcatctctcggaaaaggttccgtattattgccactgaatctttagactctatgatgatgcaagctaattcagacataaaagaatcgactgattgtagcgccagagctcctgcaagccctgttctatatgctagattgaatagtggggagcttgttcttcgaattggtgcagatcatcctgctggagatatgacattgttggaaactggcgagcctgtgtattctccaatcactcaggtttgataaatatatttttttctatataatcactatttaaaattacacttatacttgagaactttgggaccatttcatgtaggaaggacctttgcttacagaagatctaatcagggaaacagaggagtttgtgctgcggacagggaggtctgtatgccaactgagattcatccatgatgcaatctgttatcttaaatctaaatggactttccgttttcgctatatatagcgtgtgaatcccaattgactctttcatataatgaacttctttattaaaataatcaaggtcatcttgcttcttgggctcttcattgcttggatgtgttcctgtatgccttttttaattgtttcgcatgatctaaacctatgattatgacctattgactcacatctagactatgaactcccacgaccagggtctgagtctggattctgaacctatgacctatgtctttggtctttttttttaactaatttctagaatttgcattgatgaactagttgatcaacaaacattcacagaatgctattttgtaatacatttatgatcatatatctgtttcttatgtaaataatttgtaaatgctagctttctttaattacagatgtgcatcaattatgtaatagcttatagttagcatcagttaggcattttcttattacaaagttacctttcatggtcagtgttggtgctgggtgctctcaactgctctcagatatgcaggctttcaaggtaaggggctcccttgaagggaacttttcttactgatattgtgaatgcttcttactatgttgaatgtgcctaatgttctgtctgagttagttttgtttgttatcatattttaggctgcaaatcctggatgtattttggaggattttgtaagatggcactctcctcctgattggacagataatgaagcaagtacagaggatagtgatgtttttgatagtggtgaggcattgtctgccagaggtcagctaagtcggcgaatgcaaaaagaaggtgtactttcagtcttttccatcatagattgatgtacttaaattctcctgcaaggctattttgtggtatttttctacgtaaatggaccatcaacatctgataaaattgtggatttaccttgcttgaaacaattattcactgtatcttgtcatcgattgtagtaaacttttgctctatgcttataaattttaccatcatttatgtgttctttatggctttgatttccaaagaggttgtgatttggtaagttgaggaagatatgcatggaactactgaactacactatgtatgatgggaattgtttattgcagtctaatgtaggaacttttgtggcaaactgatcagttttgggtccagaatgtctaaatgtagagtttgaataattttgaatgttgaattaataatttcattgtcagtcaattgatatcagcatagatattcagatttcatattcctaattgccttgggaaaaccatggaattgaaagtgttgaaaccctattcctcaatctttgtagcatctatgtaagatatattacctaaattggatatcatatcacatctatggtaaagcatatggagataagtaaatcttgagtactgtcttacttttattataagttataacacacaaaatctgcaagaaatacgggaactgtcgagcatttactttcttctgctttcatattattaaacatatctgatttgtaggtaatttatggcgtgaattgtgggaaacatccaaaccagtacctgctgttaagcaggcacctctgtttgatgaggatttggcagtgtaagttggtgatgaagattttttgcattaatttatatatttcaaccctaaagccatcccttgaatcccttgttgcattcatttatagggagggcatcctcaatgcatttgaagacatccatccatatgatctttttggacagctgtttgtttctttagtaagttctttattttatctttttatcacattgattaattttgttgtgtatagacagttgtcatttgtcattacataatggatctctgaagcattaatattataactcataagtgatgtatattaattaattttttatttgaaaattgtattttcttattttttggagtttggtggctgaatctaaagcagattgtagaatatatagtaatagacttgaatcatgaaggtaccaatcaagaactaaactattttcctgtaatgcatgtcataggagaaaaatgtattgacatctaggctctaggcattttttgcgagtttagaattattagattggcatgccggttgggcatggccacacatcccttaacaaaacctgcctagagctctagtataaggcaacttgtgttatctatgctggtggttgaaagaattttatacgaacatataaggcaattggtcgcctccacatgtccattcccaaaatctccctagagctctaatatataatgcagcaacatgttacgtatgctggatttcaaaggactctaggtagcataggattattctttaacacatgcacacttgcagtttcacatgctggatttcaaaggactctaggcagcaacatgttatgtgtgtgtatggtagagaagggcatttgtagacaataaccttatggattatggatcatgaagggcatttttatcagttaagggcattcccattaatccataatcagtatacagttaaaaatgaaatgagcattgatagtagaccaggaagagtttaaaactgcataatatactttttatgaaatttccaatagcattaagtgcataatttataatccataatcagtatacagttaaaaatgaaatgagcattgatagtagaccaggaagagtttaaaactgcataatatactttttatgaattttccaatagcattaagtgcataatttatccaaaatatctgcccttaactgataaaaaggcccttcattatccataatctgtatcaatgttaattatttaaaaaatatttataacacttgtaaagcatttgttagtctaaaaatacttcaatttgtgtgttttgagctggctccaaccaccaataaagcatttgttagtataaattcttcaacttttgtgttttaacctggctcaaactggagtattcaaatcttcaatgtaatgtctggttatgggggtcctagatcaaaatttttggtcttgagaaagggaattaaaaaaaatggaaactgtgcaaacatacttatcatctgcctgtataaaggagatgaaatgtattacttttaatatttttctgttgaagaaggagggggggggtgggaggataaggcttttgttgttgtaaggatgggggatgttcttcctgttacataggactaatagtaatatcctgtgtcattcaagaaaattgatagccttcactggaggatgtgtactgtcaattaaatactttttttaaacatctttgtccttttttcctaataaaaaatgtaaaacaggcatttagtaaaactcctttccatacagacttcagtagcattgctgttaatttttatgaagattaaagcatttgctcttttatgtcaccaatttttattgaaaagaaatataattattcttaactttatattatttcagaatttttaaattacataaagtattttgttccaaaatgttgcttaattgataaattatcctattatataatcctgtaattttgtaaagtttcttgataaaaactcagcctgttccttcatcttcgtataagttgactcgatttgattgatatgtattgatgcttataccatttctatacctttctaattataacctttggttttaattatatagcttggtttaggatttgcaattgccgaacctatgctgtctagtaacagtgacttctcgaagttattctatgactgcaaggagtacataactactgcttgtcaaaacaacaaattgaatgaaaaagtggatggtctcgtccaggtgggtactcctagactaagtgacttatgaagttatatagcttctccctgaatccttgtgaagcctctctattgattaataccatgaaatacattgtcaatatgacatgtaatccagtggagaaatttattgctttatcctcgtatttgaacagtcattcactgtataaataaactcacaaagcagagtcctgaagaaaaaggaacactccaagactatcacaatgcgtgaaatttgtaacttttacctagcctaccttccagaactattcagtttgctgttttcttttttttaaaaaaaaaaaaaacatacaagcttgttgtgcaagataaccctacttcttaagcatggggatgaaaaatcattcccctggaaatgtaaattgataataaaactcttggttgttgatttatatctgcaactaattgttaataacatcattcaatagagaatttaatgttcgtattcctgtgtaggtatatgaaacagtggagaaaatgttattgaatcctgaagaagctctaaaaatgatcaagcagacagaggaatcaactacggttaccggtgaaccaaggagcccatttaggaggcttagccttatctttggaagcaaagataaactattgaggaagtctgtctcaaaagatcagacaaacgacgaagaaaagtcaggtcggcaatcattctctagtttctttgacagcaagtcatctttgtttggaaagaagcctcccaagtctggatccccatctccttctgagaaatcttctatcgatgctggttggacagttgtttagacaaatttcatcttccactgtgtttattgaggataagcaatgtttttgggttcctcctccccctgcagataactgtaaattttctctattcttttgccaaatacttagtggtggtattctgtagaaattttaattaatacttcattcttttttatttgagggaattgaaaatatagctttcgggcctttagtaaacattttatgtgttcactctgtgccaatacttgcaatctgctcgggtgttgaagatcctttgagatactcctcaagcttgcaactcagtaggaattcggtcatggttgacattaagttctcggtaaaaaataataattataataattaaaaaaagacattaaaaaatatatcctaatagatatataatagtaatgcttgtaattataaaaaaaattatagtagtaatgcttgcttttgggtagtttagtctctgtctaacagaatttgatctattaatataacagtataacacagtgaatttatgtttgagaaattgtatttggacatgaatattgttggaaaaagttaggaagggaagagagataataaggggggaaatattgtcataacaaatgtttcatgaatcatacaactctttacgttaatggtatgatcatgatgcccttgcaagtatttctatactaacattaacataaacataatcattgatggcaaatttctttagtacaaataaattgtattcttaaatatcaaacaataatcatattaatcctatgttaaataaagactatacttactaacatttttttcggggtagtagtaaccccagtgaatcaagggcaggaacaatttggtttcatgagattgtaatcgctaccaagtctagaatacctaatattaatgagcaaaagaaatcacacttggatgtttttattataatctaaatgcgaactaaagatacaaaagacacgtgcagtagtgcttcaaccatcatgagctcagttctcacatttacgtaatcctgtttcttccttcgtgacctcccttgactatctattcatcttctattgcatttacatcgtcaaccttctgctcttcgtttgatggcttatcatatccgaaagagttgataaggaaacctggcacgacaaaatttgctatgaagtatgccgatagaagcacagcactgcaatatataaagaaatctttagttaacttctagactttaaagatcacactaaactccattttggagtaaaaggttgttataagcctaagcctagtgtcaaattcaattataataatcatgaactatcaaataaataggaggaatgctcgcaatacattttttttttagtataccctcttttctaactcccaaatttattgcataagaagtcagacttaaataaatactaatttttaatgaattttagctaataatgaatgtgctagacatggtaatattagtaagtaacttttctccaagcaatgaaaaagggaaagaaagagattgaaccttattggaagcaaggtggacaagtcaccggattgggctggggcaacaaccagtaaatgtggaagtgccttggtacttagtggacttgctgaaggtaagtgctggccacgtggaggttggtgagtagtaagccaaaatagtttggtagtgtggctcatatgatgtaactgcggtttgagttttgcatgcaaaggaaaaggaagcagtgaaggttggaggtggaggcacctcatattgttcatgcgtgtcactgtgtggtgcttgggatattgggatatgcttatgtttgggagtgagtggatggatattttagtaaacatgtcatcctttatgtagggtcccatttttgttcatatgttctagacaggtttatataagatccagtgtatcattatttcgagcatattaaaaaatgaacgaataagcgtatagttatactgttatagtggcacgtagccaaatcatgaaaaatcctaaatcactaacttggatgattatctaagatggatgattatctaaaagtggaaaattctaaatttttaattagagtttttttaaatgaatagaacattaactttaataattactatgtcgaatgattatttttatatttttatttatttatgacttaagtttaaataaattaatattatgtttgttttttttttaaatattatgtgcatatatnnnnnnnnnnnnntgattatatatattttttgcattagttttaaatataactgattacatcaattatagatataatcatgaaaaagtatgacaaccaaacaggagatgtcactcgctgtatctcctcttgctacaagataaaaaaaaaaaaaaaaaaaaaaaacaagtataaagtactactactctgaatacttccacaccctacgtaacaacaaaaacaactggtgctacgtaaattattttcaaacttgtattatgaattgtacaatcaacaatccacttatgctaaataattaccatataacacagttttttacgaccgagtccaaattgcactcaaacttaaaaatctctcttttcttcctttctctcatttttgaatccgcgcaattccaattcacctcttcactccttcatcttttcgttctcgttctctgttcttccttttcagtttctagggcttattattattcgtttcgctttccgccaagtttctcgcgccctaacagtttttccccgaaacctcgcaccgacgcccgagaaactcgccaatcgatggccgcagaggaggtggctcctctcggcggcagcggcgattcctcgtcggcagcggcgagggttccgtcttcgttcgtgaagaaaggcgaccggaaaatgttcacggtggagctccgcccgggagagacgaccatagtgtcgtggaagaagctcgtgaaggacgccagcaaggtcaacaatggatccgcttccgcaccggagcatcgcagtcccaatgcgaaccctgcgctcgtgtccagaatcgctccggtgagcctctttttaggtttcaaattgttgtttcgagtaataatgtgtttctgaaactttcgtttagtttttgtgtgtttctgaaatttctgtttacgtacattgtgattcggtaagtaggttgcaatgtgtgagagggttactgtggtgtggtgtatggatgatattttgaattgtaatttgcaaaagtggtttttgactgagccgtgactgtgttttcttttttttccggactgaaataagggttaggaatgaggatagtgttattttttagaattacgttctgctaaaatgttaatgattgacctggcatgttgttatctgggaagtgcgcgggtgtttcttgtcggtttttgacaatggtttgtgctccgtggcagtgatcttaggtgaaattattcgaaaaggttttgtcgtggcaaagttgaattgtttgtggaattacttgtatttgacttgaaatttattaggtttatttaggttgaatgcgttatgcttattgacttaatttggattcgtgttatgccacgatgtttcttgttggttttcaacaatggtttgtgctgcgtggtgctgctcttatggataatcatttaatagggttttgtcgtgccaaagtcgaattgctcgcggaagtacttgtatttgacttcatatttattaggttgaatgcgttatgcctattgatataatgtctgtctgtttgtatttgtgttttggccagtgttatcaatggcagatggcagaagtctgaaattccgccatataaacatgccattgtgccttatggcgggcctttcttcacaaattgcctatggtggttggtaaaaaatctaccttgccattctgccttggctgctagttaacaacactggttttggcatggcataattgcgtcagcgctaaagcaaggaaatgttacttctacgctgattagttgacttgacgtgaaaatgtgcatatccggatgcaaatccaaacacagtaacacactattaatgtgtggtcctcttttaaatttggtgaaccgatggaacatcatgtcatttgcttttatttaaagtgatatattagtgtaattggagttaatgttatgctaactagtttcataactgaagccttagatttttctcattagtttaaggtagttggtaaaaaggtgatccagagtgcgaggctctcaccttttggggtctggggagggtagatgtacaaagccttacccctgccaagtggagaggctttttcccaataggtgaacccatgacttcctggtcacagcagcaacattactgttgattcaaggctcacccctttgttagagggcattgtatttggcataaaaatcaataaatcaatcagtattatttgcatgaatttttagttgttccatacctttgtcttctaccttcaatacatattcttatatgtagatgtttttattagctgaattttctttttgagattaatagatagatctgaataaggctctattatttgagaaacaaataagtttagcaaacatctataagttaataggctacagttagccagtatctggctcctactttcttttaataggacaagtgctgttgtttggattctgttcttataattcaaaactatacaatacatgtagtatatatctacttatttgtagcatgaaattatatggagtcaaggtaatcgagccttgaattgactctgtctggttttatgctacagtataattatttgtcatctggataccagcaggaattagcatattgtctttcgaaatagtatgtgactatgtgattttgtgtttcactattttaataacacttgtcacttttagggacaacctaaggagattgaagaacagggtgcatctcagacaaaccgtttcagtgctgtaatagagaagattgaacgcctttacatggtatgggtgtgttgcttcctgagattgttactcaatggtctgtacaaaaataaattggtttctactataaattcatatcatagatgcataagtattttattaaatttttcgagctattttccatgttgggaataatgggactctgaatcatttttagggtaaggacagcagtgatgaggacgatgcacctgatgttcctgatgatcagtatgatacagaagactctttcattgatgatgctgaattggttggtatctttttataccatattaatttgtcatgactcatgacattatgaccatttgacctttgattaatgatgacaggaattgctgaattgtattgtcctatattgttgccgtttcaccttgcatattttttatgtagttctactgttctttctgcagaatgagtattttgaggttgataattctgcaatcaaacatgatggattctttgtaaatagggggaaattggaacgcatgtaagtgttttttgtttgaatattttcggattatggcaatttcttatctttgtgagggctagcctttgttcaacactaaggctgctgccttttggcctggaggtcaccagtttgaatcctggaaatagcctcttcacttgtggggccaagtctttgtgcatcttccttcctcaaatcttatttggtgggagtagggtgttcaaaaactggtcagggaaaaaaaccaaaccgaaccgattccgaatttgaaaccaaatttgagaagtgatttttaaaaccagttcagaaccaaattggttttaaaaaactggttcagaaccgaactagtttcaaaaactagttccaggactgaactggttttgaaccaattgtaaactggttttaaaaccagcttggttcgaaccaaacttatttgaaaaaaaacaattgagttttatttaaccaaactggtttggttaaaaaaccagtgcagttcggaaacagtttggttcgaaccagtttatatgcccacccctaggtgggagcctcatgcactaggttgtgctctttatgtctatctcttttctttgtaaaccacttaattttggaagcctttgcactttcctctttttcagttgatggatataatactacattttcagtggaatatatatgcttgtgttgttatatgaacatgtaatgagatcatgtatcattcactggcatagtttgagtagtgacaaagactaatattagtgttcctgtaacttgttaattttatgcttgaaatgttggtcttgttacattgctgattgttggtctattgcactattgttctaaactttgaatttacttttctgtacctatcactttgtttgacttaaacatttcatcagttataacttaaggcctttattagtatttgatgttgtgaagttctttcttcctgttcctgataacattttttcttggcttatgattgaatattctttcatgtgacacctgtttacatatgttgtgccaacattttgaatctattaaattgtagtttggagtagataattttttcacacaaattcctgattttattgattttctgtttcttctttctatattaccagaaatgaacctccagtattgcctatccagcaagcaaagaaaagacgccgaaaagatataccgaagaatcctggagaaaatattgatagtcatgtatcaaataaacatgtaaaagttggcaatactgctgctggaaagactgcatcattacctgtgaaaaatacaattagttcctcccataatttaggtgtacccggtgaacattatgaagacattaaatttcggagtgagttagatgtgtctggaattagtttgaacaggaaaactgctgacactagaccaacatcagatcttcctgtttgttcgaaagtatcaaatgatgatgctcctgccgctgcagaagatgctgaaaaacagaagaccaaagtacttcaatctaagaacacatgtgataaatataaagatggaagtggcttgcttgatacttctcatcagaagtaccatgaaaaaagtggatctgcacattccaaatcccagcctggaaaaacctcaagtagtgttgacaatctagaaaagactggtcggtcgaaagataaaaatggcatcaatgaactgccagatcttaacttatccgtgggaaaatctgctagacaaacaccagtaagtttacgtagctgcttttcggttgtctttattttatttctatgttccagacggtccttttttagtacttaccctctttgtttcccccctccttctttcacccttcttttattttatcttattttcttttcttttgtcttatttcccctttatcttcccctccaccttcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcctttttttttttttttaacttcctcgtatctatcattgggctcatctaccaccgaccctaattaacttaggttaaaggtgctgttgatgttgaagaaggtttgctgcggcacttatatcaattcattcttgctattcagctttaaagtaaaggattctccattctaaaccatagctaccatatgaagcatggaactgcccaccaaataagcacttctagtagatcaacttccattgtgattaacatattacattgaagcatgacatgcattgtgccaggaaaagtgtgtgataagaaccttgggagaatcatattacaaaaactagccgttgtagttagagagctcaaagtcttataaacacaaaaccagaatcccatacttccaacatgagactcaagtctcataccttgcaattggatcctatcatctcaccatgattggcagccccgatgccccttcacgttggctatgcactagttctttgactagtcccaagcaaatactgcaatgttgtcatcatccacatcgctcgtttgcaattaacagacacgttgaaaagctttaatgcgaattgataagaatcctaagagaactacaccaccaaagctaactattgtagtgggagagccaaggtttcttactttgtttttgcatgggagtgggtgttgtatctgcaccctaaattgggctactctccaacccaagcagtcttacaatcgaggaggttttcttttgcctattatttttatttttactataaattattctataataaaaactaaaaaactaaagtacaccaaggtttcttactttgtttttgggtgggagtgggtgttgtatttgcaccctaaaccgggctactctccaacccaagcagtcctacaattgtggaggttttcttttgccttttatttttatttttataattaatcatatattatactatatattattctataataaaaacttaaaactaacgtaccccagtgcccaaaggctccttgctatgtgaaggtaggggagagggtcattatacgcaatcttattcttgcatatggaaagaggttgttttcgaattcgaatctataaccaattagtcaccaatgcacaactttaccattgtgctagagctcaccttgataaagtattctataatatttaaaaactatagaaaaattaatgcataatatatcatataatagagacaaatgtataatgcatattatatatcactaccttcgtccctaaatataagacttttttaactaattcacatccttgaagaaaatttgtttatttggttagcaacattaaatttgttttgcaatttgtattattttttcaaaattacccttaaaattatgttaactcatcatctcctttccacttaattacttttttcctaattaattaatgtgtcctagtcttctccaatccttgtaagagaaagaatgaatttatcttattaatttattgcatttattgtaaagcaattaagggtattgtggtataaaaaatgtaaaagacaacttgaaaaatgtctcatttaggggcagaggtagtgtatatattatagattattataataataatataaatatatataaataaaatgtatgtaaataaaaatgtaataattaaatattataatataatataataataagaaataaatataatagaaagaataaaaaatattttatatatacatatattaaaaatagcagtcatcccactattgtttttgggagtgatcccgtgactccatccactatggactattattgtgggattaagtctcataccttgtgatcggatcttaacagtgtagcatattgcttcaatttactccatttacttgttaccttggctgttgcgggtcatcctttttcattcaaaataatttctatttaagggatattggtatacatggttggtttttctttaagattttggcaaactatactatccatttagcatgcacttggtgagataacatgttcttattactatgacttctgacaacaaaagttgtgaaagtagactgttatgtgtttaacatatactgtgttgatcaagatcttgtttgaagcttatgcagaaatctgaaaatgtgctcaagaaagatggttctgttgctaggcctaaaacgacaacacttgagaaagctattcgagagttggagaagatagttgcagaatgtaagtttggaaaatgttttgaagctcacattataggcaatgtgggaagtttgttgctaatgctaaatttttattttaaatattattacagcaaggccaccaactatggaaaaccaggaggctgattccacacctcagggtgtcaaacggagattgcctagagaaataaagctgaaacttgctaaagttgctagattagcggtattggcaaattttgttttcttcttatgctaaatgcttctagatatatgcacaattttgtattatttttttctcaaaagtcttctcagtttgaacattgtattatcatattgtaatattgactatatgtttttgttgcagcaggcaagccaagggaaagtatcaaaggagttacttaaccgtcttatgagtattcttgggcatctgattcagctcagaacactaaaggtatttaagcttgataaacattatgagtatgtatttttcagtttccggttataatcccccaatgcttagcaggagctatatagcactaggctgcctttttgttgttgaacccaaaagttatacaaaatttaaaaattgaaactaattattgcatctctcaaatcacctatcttgctgtccagtccactatcctgaacttttgtacaatttgtagtttgtttagtgattaggttatgatttaacaataccatattctaggctttgaatacattcgtgacctaatcacattgtggtttgactgagtgacttacttttgtgaccttcttaaagattgattctcttttcttcctttttttttttttcctttaccctttttatggtgatttcaatgtcatatgtctgagggctcaagctagggtggacaatcctcataggtctcccacggtggtagatgattttttcaccattagatttgttacttctaaaatcaagcattcaattttttcttcttttttcccaatctgtccctgccccattctctctcactccatcttgttgcttcactgctgctgcgatgacacaagccactgtcgacatctctaccataaaccgccctaggatggcagaatgtctactgcaaccaccataaactaccgttacaaaccacgaccgaaaacaatcacctaaaaccaaaacaaatcacaacccaccataaacaataaagaaaaccagtatcaatggccttcgccaagtccaccagcactgactcaggcttccccacgcacactaccagattgaagctgtgtgcctagagtctctggcgcaggtcagagacggactcaaccagggctgtgtggcagcgttggaggcagactcagcgtagttagcctggttgaagcagtagacggggaggaaggctagggcttgttgttggtagtaatgaggcagttgttgcgaaaccagacgaggatggcgcaacagcattggagggttcgcattgcggtggtggtgggagcctagggagagatggtcatggagaggagagcgataacagggcacaggggatcttgggttggatgaagggggaactgatggggaaagtgaggctacagcaaatggagattttgcagtggaaaatggcgagggtgtcaagggcaaaccaggaaagataattatcaattataaaaaagaaaaagaaaaatgtagacctttgatttaaaagataataaatccaacagtgaaaaaatcatctcccaccgtgggagacctatgagggttgcccaccctagcctaagtcatgtctgagtctatgaaattcttatttttaagtgattgtttgcccacttccattttaataaaaactggttttccttcaggaatgaaggacctgtttgctttagactttggtgactccacagtgacagatggccttcctgaattgattctaagtgcaagatcagtatagattattttgggagaaatactagcttatttcctaaaaactctctcatgaagcaggcaaaaataagtaattatccttcaaataaattgaaccaaacatgcactaattgtaattgatcaagtttctcaagttcacatttttatatagaaatagatttaggaaaagtaaagctttgttgccttggtgagtagaacttgcgtgtgttctatacccacgctctttgtttataatcatggattagggtagaaagaatcaatcatggatacgaaaaatcaatctaaatccctaatttgtggtaatggatacactctttacataataaatgtttttcttctaacactaacagtagaagctggtgattttccaaacaaaaacaactctattcctatcactacaaaattaattttatgtcaagtggactctaattatatttcagaagttattcttcagtataaaaatcaaacaaactcaaccatgaactccgttcttttacaatccaattcaaaaaaaggtaatttcccacctattatttattgtttatgctgtcaatgaatttttgcaactatttttctctttgtttataatttatatttatatttatcgttagataggtaattttaattaccatttatgcttgaattgaaacttatcttctcattcaatgtcttcctgctacagagtaacttaaaaaatatgatcagtatgggtttgtctgcgaagcaggagaaagatgttaggtttcaacagataaagaaagaatttattgagatgattaagatgcaggccccaactatggaatccaaggtttattatagttacaattttctatttcattccatatcaaaatcaaatattcagtactttttgcttgttttagctggttcatgtagcttctttttgattccccctactatagttataattcatagtatacttattttcactctttcttatggatgcttctttatatcgattcaatgcaattttgagttttatatgcaaatccttattttggcatgtttacttatggataacttttacctggaaagggatttccttagttgtagttatgaaactcaatctagttttgttgatatatttcctgatgtttgcattgtatcttgattgcaattttacaggaaataactgtaatttcgattgattaatgaagattttggtaatttaatatgggatgctttttcatgttttcctgcatttcagctacagcagcaagctggagcatctggggaacaagaattaggtcctgatgggaaaccaataactaaaaggaatttttgtgtggacactgcattggaagacaagatttgtgatctctatgacctttttgttgatgtacagaagtttgaaccttaagtatttattttatagatcctgtgcggtttgaagtttgttcttaatgaatcttattttcaattgttccaggggttagatgaaaatgctggtccgcaaatcagaaagttgtatgctgaggtggttcaaattttctatgccttcctcgatatttgtttttaaatttcagactttcagtaccttcttcctttgggtttgatttggtttatttccttttctatatctcctagtttaagttaaaattactaaattagtactatctaaaatctcttctatcatttcttttcaataccatagttatcaatagtgctcaattgcggtgcaattgcagaggtgcagaacagaatgtcattcggatgtgacaaaactgccataggattctcaattattttttcacacatgtaaattttttcaattatgttgaatacattgaaaagaaaaggattctcaattattttttcacacatgtaaattttttttattgcaattttttccttcttttgagtcctcatgaatgaatctcttatttcagaagcttgtgttactttttgtgtgtgactgtgtgtattgcatatacattgcagtttctggtgtctaaattaatatgtttgcgttttctaaacatattttttctcactttcaagtgcattgtcctcttcagcttgcggaattatggccaaatggttacatggacaaccatgggatcaagcgtgcaatttgcaggtcaaaagagaggcgcagagcactgtacagcagacataaggtatgcctttgcaataaataatagcatataactatggtgtagtaatattctaaaatctctattaaaacaaagaagcctttacagtttacatgttctcagttttgaaaatttaagaggagtttcacgatagtaatttgtggtctagcctgcaaatacctatgtggcatgactaagttggaaactaaacaggagtcttttaatttttctcttcatccttaccttaattatggctttaaatagataactatgaattatgaatcagaagaattggagaatttgctttctgttttttgtatgtacagatgacaatcaggattttatatttgtgagaaggcttaaatatgtttttgattttatatatccctttttcagtttactacctaaatatatatttttatttattttactatctgacatttccaaacttttgcttttggtacctgtcgttagtctcggtcccttgagtgatgatatgacaaattaacagtcacgttatcacctaatggacttagattaaaggtaggtaccaaaagtatcaggtagtaaaataataataaaaatatttaggtagtaaactaaaaaagaagtatattacaggtatgaaaaacatatttaagtcttatgagaataatgttttttgttttctatctcactggttacttattgttaggatcaggagaaaatgaagaggaaaaacttattggcacctcgaccaaaggagaatgttcaacttgatcctagtccaattacttcccaacagcccatgcgaacaagattagctgcagactctagttgtcatactcatgcttcagtaaacaagacagtttctaatgcagtcaccgctgcacgggttcacaatccttcggtgaatggtcctaaacaagaaaaagcaaagggaagttcaagtggttctttggttcacgtcaagggtgcagacggtgttttaataaagaaggtaaagagaaagccggaacagggtttggaaggaactcattttcgccctgagaagatggcagcttctctgcaaggagaagaaaagcaaagatccctaaagcagtctgcaggtgctccccccaaatcaaaccttcagccaacttctttacctggtctggagcagtcaagctaacatgaaatcaactaggatgtttactcaacagaatgtattttacagttttttacccctatttttttttttggctcaattctcctctcccaaatcaattcatatactacttattattacgatttttgtatataggtagatttgttggttgttaagtcatcgcgtatttcttgagaaatgaagtcataggcacgtaggttcaggggtcaaaagactatccccagagcacttgtctcacgaacaaacatgcccccccaaagccaatgtagtatttctttctatctattattttcggtcaaaagaggctatcgttccttggctcactgttgatttgcacaattgatcatcgcgcttggttgaaaagctagtggtgcgaagctatcgtgcattggattatgacaggacgtctttaagtcagaattcgggttagaagtgatgcgtgaactcgttattcgtttgtcgaccagtagtagggggcctggaccctccaaaggcacgtgttgttggtgagcttcgtgggatggattagccctgtgagacgtcttgaagcacaattcccattgagcggtgaaaattttttcttgactatattctaatgaaattctataattactttattttttattataaatagaaacttgttccaaatattaataatattattggcatattgaatctggccttaccatacttcttgtagatagtggtgcttctgaaacaagcttgaaattttgatgaagcagacacaattaatcttaaatttttagtgtttcataaaaaagtgtcatcaaattagtgatccaaatatctaaaatatcaccaaggtcattatagaggattaaagaagtgaaaaaggaaatctaaagtttaatttagtaacaaattaaatctttaaaagaaattttaaaatattaacatttttgtttttatggatgattgaagtggtgataatataatttggaagggactaatttaatgactaattaaatatttggggattaatttaatgactatttttttggggtaactaaatttgtagaaaaaggtttttggaaaatataattcagttaagatttttgaaagattataattattatagatattataatgatgatgtctatttgtcttcgtattttttagactagtatattctttaaataacattatacactatcattattatattttaaatgcatatgaaagaactaacccattaattacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaaatatcaaaagacttctatgatttttggtaattttaaaataaaataagtagttttgtgatttttggtgtgtttgtttaaactatttttttaatatgcaagtcgttcccttttaaaaaatgagccttacattaattttatcaaaattaattgtgattaactttaaggtttaattgtaatttttaatctcaacttttatattttggcaaattttgcctctaataatattttgatgcattttactctcaacttttaaaatctttcaattttgcttccgttccaaatttcactaacatttttttggccatttttaactatcactgaacacacctatttaaaataagtatctttaacatagtaaattagtaatgactaaaaaacaccattattattattaagtccaccatatatcaaacaaagacaaaaaatcagagtctaatgtatataactcattggtgctaaaagactaccttacaatgatatactaaataaaagggtcggacaaaaaaagtttcaagttgaatatcagttgacataactgataatggtttgcgttattaaccaagtgatctaggtttgaatcttggttggcccttgggtatagaataaatattgttgggaagagaatacccatcttgtgtgcactcatggttcccgacaaaagttcgtctttgctttcgatgagaactaattcgtaccaacactatggccaccaacaaaaaaaaagttgaacaacaattactatttattggcacaaatgttaccaaatcctaagaacaagagggatggagacaacggtgaggccactatggatatccaaggttactttgtgactctacatagtgccaaaactattacagggaacgatcatggatagatgagaaactggttttgcctggcaacaaattgattttcaagtgatgaaacgaatatctagactttaattttcgatcaaattcttctagcatagctctcacccataattcatttcatctatatttttttgttctactccttaagcaatgttatagatatataacttcaatattttctaaagtgagttggagcccttactcctccaaaaatttatcaaatgatctcataagatgaatagcttctagcttcttccattttctccaatcgttcgctctctattgagaagttagaggtttaaactgtgacatcctagatgctaacaatggtgaggaatgatcatcgatgcacaagagatgtgtcacaaacaaagagcgactcctaacatgtttctagcggaagggatacatgaataaattgaatatatacccagatgaaagatatttagagattgtgtaggtctgaaactgtacaattaaagatgacttatagaaattattactacctataccaacaaaaaatatatattttttaatagtttataacttaagaattctacaattaagtgtgtctgatttataataattataagataaatgataaagaaattgtttgatgactcaattttttaaaatcaaaatgattaagttttagatcacatttaaaataaagtttaaacaatcaaatcacatatttattaatttaatcataatttagtattttttatttttatttttggtgcgtaagtttattgattattagttttttggttttggatatattcgaaacaatccgctaatggatttttcaatccaagaagtcagatggattagttttattttaaaaattatgattaaaatgaaatttaactttgtctaactcattttttttatctacataagtactctgacaaataactagaacattccatgattgattggaaatataaaaaaatacaaaatttaaattaaaaaaaatgaagaaaggtttgatttattgaattagcaacagattattttatcagtaaaaagatatgaattaaaatacaaagattcagacgttggaaactactaatttcgaaaatatcataaattgatttgattgataaaaatgcatttaaacaattaaattagagaaatctaaatattatttttttttccaaaggtgaggaagaaaaataataatatttaaaatttgaaacacgcgatatttgacctggaaaatagtattttcaagacagtaacgaaaagatagggaaattagacataagaaattcaattatagagagcgaatataatactattgttcttcagaactctgtaggcggcgatctcctttgtcaccgttccatcgtcaaccctacccttctatctgcgtttggcgttcaggttcgtctctctttcccgagaaattagcttttctatttttttcgcagcgcaatttcgcaaatctgcatctagaacggttgaatcgggaaaatacatcgcaataggtatattgttgttgttgctgttgttgttgttgttgttgttgttgttgttgttgttgttgttaatattcttgtttagaaacgtaatgaatccgagacgttatctatgcaagcattttccgttcagtcttattttttttttttttttatggttttgttggttgaatttgttatttgtcaaattaggtttgaagtccgaaggacgaagaagagatttctgactgcgtaatcatgtttggtgtcgtaaggcgaagggttgcttctggcagcccgtttcctcgggtgagagctcggtcttttctaaacgcttatgaatcatgatgaattttcaatttgaatgtgtttgtgttaatccacagattgaagtttaagtttaagtcatgtttgatgcgtgttctgcatttgtttcagttgcttggtcagtcagttcagaagattcggtctggcccatcagtttctgctagagcttcttccattgcggaaaaagaggtggttgtctttattttctgcatatactctgttgatatgttttttcttcttataacttataagatactgatggttatcggttctccactgttaacactgatggttactcaactattatgtttaggagatagggttatgttgttagtatatgcaaataaggcagtgctcacttttagtccttcaaaataaaattgttcgttttgttcttggtggcaaaatgagactattttattttgagtgtgtaagagcgaattatatttatagaaactaaaacatattaaccctttgggatatgtgttaaatgtactacctggacaaatagaatgtgaaaatattgggtcgagtccttggtggcaaattcctaatcttgcttaattgttgtaattgtttttgataaaatttctttcatgacctgaaaagactctgatgctcatctggtttgtccttggtggcaagttcctaatctggtgcatttcattttctaactttttattttttgacgttgaaactatttcctacatctatggcttctggatttttcaacagtttgaaaagtaattggtcattgtcatttctgtttatgaccttttttctcttgtgtgttgtttgaatcttgttcaaaatgtggttggattaacatatggttgttcaaattcaatgtgatagagtaagtttactttttttttactcaattatatcagcaaagtatggcaattactaattgatatatagactgcctgctttgtgtacagactacacaatgtaaatttcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttttcccactgttacttatggtctttgttatagagggttagattttagaatttatatgttatttgtatcctttgaagtttcttacaactattgttttattatgattaacagattgcatttccttcaggcggaggtggatttgtccaaaacttcagtcatataacacttggtaattttgggtacattttattttaattattttagatgctgttgacttaattacttgaatgatttatgcaattttgcaatttaaatcataaattttgttgttgttgcaggaagctggattaattcaaagcctatgaggttcgtggcaccatttaatagtcctaagcattgctttaggattctctttaatttatgtaaaaaagtttggctcagaaataggatagattgtaagggtgctcttggtttagaattttggtgtctttaatcttttccttgaaaataacaaatacaattgaaaacatgttttagttatacaaaagcttaaaattagctggagtctggaaacttaagatcaagctctccaaccaggctttcaaatgttagaattaggtacctttggggaggggttaatttacatgtatttcgtctttggttttttctttttgcgcgatctgtcagaactttgtcggctttggtataaagccatcaaagttctgtgtagattccgctgttttgtatcttcagcagtactccttgtactgttttatatatatatatatatatatatatatattatctttgctgataaaaaaaaaaatgttagaattaggtttggaagcttcaacaacaatcttattgtttaaatatagttagaagttagaacaaaaataaagtaatgcagaaatgtttactgacttcaggaggaaaaaatggattggtaataaaaaatatagtaagaaaatgagaatatgaaattgttttcaaatccttagccaatcaaatgattcgaatccttaattttagtcatgacaaatttggttgtactaatatttccttgcctttttcagtattatttagctgcaaattttactctttttcttgtatgttgctaatgctagcttatgcacataaacattcatatcatgtggtcatcttcttagaaaaacccaagtatttaaatttattggtgttattaagggaattgaatgtccctagatgcaaatttgaaatgatttttttttccaagaaaaaaagtagacactaatgcattttctgtattcttctatagttttatttgtactcgatcaaattctgttgatgatcttttcacatggagttccgggggtgcaataatgacaaatcattaattaataataggatggaatggaaaatagttacaatttcttatccagtgatgctgttctgatattgccttattgctctgtagggtggtcattcatccagaggcaaccgttcgaacatgggggcgtctattttcttcagaaagtggtgagctattgatgtgacactattgccttattgccctattgatgcgtctattaatgtaccattcatttttctggcatttacattgtttagttaacctgttttattttggctttcgattgctaatatttttaagattgctaatgttatttatatttgtgataaaggagatacggttgatgttgtggttcctcctttggctgaatctatctctgatggaactctggcacaatttttgaagagtatgttatcctgtatatttttttcatcatctatttgaattgttaatttatgaattattggtgactgattgtcgtgttttgatttgttatatgggagcaggacctggtgacagggttaatgctgacgagccaattgctcaaattgaaacagacaaggtgctatgtcaaagcaacatgcagatttttgtgaaggattttgatggttataaacatttaattttcttgatttccaaataattaatgctgtattttgtttttattccttaattaggtgacaattgatgtttcaagtcctgagtcaggcgtgattctaaaggtacagtttcatagatttaaattgtttttactctcctcaaccaccctgaaatgaagaaattgttactctcttttttctcgtttcccttttattaaatttggcttgtgtgatctatttaatgatttgcagcttctagccaacgaaggtgatactgttgagccaggtaacaagatagcaatcatttcaaggtctgctgatgcaactcacgttgccccatctgagactacatctgagaaagctgctcctcagccaacccaaaaggttagcgaggagaagaaagctcccaaagttgaaactgctcctgctaaagagaagcccaaagcatctcctgccattctgaaatctcccaccgagccccagcttcctcctaaagaaagagaaagacgagtgaggcattttgatttttggtcctacctgaattatatttagcaaccatgaaagttgttttaatgtcttccattgttatcaaaggttcctatgacaaggcttcggaaacgagttgctacacggctgaaagattcccaaaacacgtttgctatgctgacaaccttcaatgaagttgatatgtaagttttgttgattgtcaaattgtagcataagattttaatattgctcaaactgtttttttaccccatgtgtataaaaatgcactattacattatttggtgatggttctaatggaacacagttgtctaaatttaatgaagtgctcaacgcatggtctgtcctctacagctatgatacattggagagtcattacatttctgttaatttttcttggtctttgtcagatcaacaaacctgttacgtattctctcaatttctactttccgtagttggtgtacatttcttattttttttgtttagaagaaaatagggcaacgattgactatatgtattggggttgaagcctttttcacttggatttatgcttagctttttgctcatctatgtaattttacattatgccactgtgttagtagtttctatgcgataacacccagtatcgtgggatattctgttgattaaatgagggggagggggagggggaggaatgtaattcagttattatgtagacttaatcaaaaagagtgattccatgtgtttaattgtcaattcttgatgttgtgtttcctgtcatatccttatatagtggattactattatcattctcttattgctctgctcttaatgataggactaatttgatgaagctccgttctgattataaggatgcttttgttgaaaagcatggagtcaaattggggctaatgtctggctttgtcaaagtatgttttctaattactgaagtatagactagctgggttttccctttttgatttcctcatacactttttatggtctccatgttaggctgctgttaatgcactccaacatcagccgattgtcaatgctgtcattgatggtgatgatattatatacagagattatatagatatcagcatagctgttggtactccgaaggtttttatcagccacctttatcttttctcatttactttgtttacgttgagaaatcaatcaatcattatactgtcttgatgaaacttagccatctctgtgatcaacttatgtcaactattgtcatggctatggagctaatttactggtgatctagtatatgttgtctaattttgcaattttttgcatggccatgaaaattatcaacatgcatgttgtatttgaacaaatattgacccccaatcgccattccagggccttgttgtaccggttatccgcaatgctgataccatgaactttgctgatatagaaaagcagattaatgcttttgcaaagaaggcaaatgatggaactttatcaattgatgagatggctggaggcactcttacaatatccaatggtggtgtttatggaagccttttgagtacccctattatcaaccctcctcaggtttggaagttatactaagataaataccattatatttttttctttaatttgtaagacattcttcgatatgttttgaagttgtttctgtatgtatatgattgtacataatcattgattgctttccttttatcttggtaggttcaggcattgtttatcatttaatgaaaatggtcgttatttttgtcaccagtaactcttcaatatgcaatttgttttcacagaaggatcagtttaattctaaatatcaagccaaatactctgatctattcccttaatagttaaatatttataattgttttttttaatgatgctaattattgtgaacaataaaatatgaaattaattatttagaaagaaaactcatgcagttattgtttttggcagtctgcaatcttgggtatgcattccatagtgagccgtccaacggttgttggaggaaatattgtcccaagaccattgatgtacgtggctctaacatatgaccacagaattattgatggaagagaggcagtgttctttctgcgacgcatcaaagatattgtggaggatcctcgcaggcttctgctcgacatatgaagtgaacctctaattttaaatggagtaaattaaacctcaaaattcaaataccataatgggtactcttttgtttaggttttgaattgcggctgcccgtaatttataatctgtaatgagcaaactctttaggatcatatcccaatttcccttcgatattaattcagcatggttgtgttttttctacccactattcctctcatttaatatgaagagggtcacagttttttggctccaaaattgtatgaaacgactatgaactatactgtagggattgcccctggagtaataagacgatttcttttcatggcactttattcttacactattttttagcggatgaaaattttcagatacatatcatcatagggtccaagaaagcggggatgatataatatggcaataatacactgccgtaattaaattccttctagaattcccgggtttttatatacgccacatcgaatgtagcctctataagttaataattctcatgtgaaaaaatgcttttattttatttttttaattaagagcttaatccaaaaaaatatgcatagaattcaaaatgcaaattagtttgtttgctgggaacatgaaaaatggttgacgagagatgcatggtgataaatatatgaagagtggtttcattctatcattctaaataataattgtatatcaattattgttagttgtcttctcaacattgccaagcttcaacatacgtcctttgtattgctcaggtactaaaactagtatatattgcatataatatgcttgtgtaaattgcaaaaaaatcagggtaaaaagtcttggatgatcaaggcaaggttttatattctcaagaaaaagtgaaaagagaggtaattgataattgaattgggaaggtagagatcactcaagcttgcaggccatattcagttttattctcatctaacgtgttgggactgattcctcttgttcaaagttattctgtgcctgctgcggtcttggaacggaaagcatggcataattctttgcctaaccccacaagtctccaaaagcagcttataaacacatggtactcaaagtcaaaataaagagtttatttttcatccaggctctcatcttacctccaccgcagaaatcaacatttaagaagttctacaaagatgatacaacttttattcatacttttgatgatccaaatagcattcatcttaatattatcttttgcaaatccaatacgaaaattggtgatcatggggctagacctcttgaagcaggggaggggcaccttagtcacaaaaactgtagcagcaactatgtgtgtggtcttgagctccaccgtgtatactataatcaaaatccaaaagcgttccaaggatgctggcatagttaatccaactgatgaggtgttgatggcacatcgtctcttggaagcagctttcttgggtaattactcaaaaaatacattccttgtttgcttacaaagttacaatacctgcattactattttgttacacacaatagaaagcgaacttacttaccccacgtgtactagtgtatgcatctgtttattttcataacttctctgaaaggtgacaagaaggttgaaatcatcaaaatttcactatggaagtttacaaataaatgtttctctaggcttgactcgtggcaaacagaattgagaaatgcccaccaataaatttctctattaattatttgaagaggctatatttatagttttgaatatgtgctaactaaaagtagctttaacatattttgacatttttttatcggcaaatgttagttactaataattaattttttattagttaagagattcaaacctacatctcttccccttttccttttcctttcaccatcaaaccaaccttataatccggttttgttagcatattttgccattactcatgcttggacaatgcatttaattgagaaatgaattctatcaagtatcaatgaatatagatttctctttagcacttctgatatactattatgtgcagaacatgagttttaaatcctataaaatggtaattattgggcaggattctctctgttccttggattggtgatcgacagacaacattactatattagagagattaatttactgaggaagaacctggaaacagttaaaaaacgaaatcacaaagactccttaaagagaatagtggaaactgagaagtcccaaggtcaagctcaagtaagcggaaagtaagacacagttagcacataaccaatgtcctgaaaaggaaaaaatctgaaggaggagaactgtcttaaagcatgaagatgttgcatgtcctttgtatgaatgtgcaacgctcagaattgaattgaactgaatatgcatacataattgttctaattgtgtctgtagttcatataaatgatttattttatttttatgtaacaattactgaatataaataagtttcaaatttgaagatgtgcgagcattcatgaattacaaaaccataactggtagacattggaatatcatgtttgttataaatgacttcagagaggacatcatatgtaagaatttgtcatttttatattacatatttaaatgatcgatataagtactttaaaatgtcttaatctaataatactattgaggcaaatgttaaccagtgctcttagattatgttgtccatgaccttttttacgcactcgaatggtctccacaataaatacttctccttttagttccttcaaccactgtcagccaacaaaaaccaggaagttactcggtataatgttctttctcatataaaattaacatgctttgctactaacatagaaagtatcaaaccaacatcatatgtaactgcaacatcatataattcataccaacatcagcttgacacaaacagttgcacatgaaaaccttaataaaggcttaaatacttattttagaatgacaaagatacgaacttcaaagcaggggagaggtaaccaagagaccccatccacaatctattacaacaatacttaatccatttcaggttggtaatctattggctgtggtgactttgctggaggcacgggaggaaacaatggtgatggtgatacggatactgttggtgatggtgacaccggcggtgatggcgacactggcgttggcgttggcactgcttgctcaaaggcacacaatccaaatacacataacctcccaagggggcatgctcttccacacctaccacagttgaaaatgttcacatttgtgtttaagcacaaacggttgcagcattgacgattcaacgtgcacctaaccccacaaagcccacaattttctctgtctgtagtcacatccacacaacggtctccacagcatatagaccttggtggaaactctcctctgctacatatcagtggtcttcccctgcatccaatgatttggttctcatctttctccatcaatgatgttgatgaagatgaggcatcagtgccattctcatggacttcttttggtgttggatttccctctattttgatcagcaacagcaccaccaccaatgttacaagagctgaagattgtgctcttagactcatcttgaggaagtggcttgaagggtagcattttggaaccatatatatatatatatatatatatatatatatatatatacatacatacatacatgtttatgtgaaggtaaattgcttttcttacaagccaaaggggcatgtttttcttgcatgaataacaaccatggtcttgatctcgtgttatgggcggtggacgttgtctatatatgtgttcgagttacatatacactagaaggaatattttgtcagctagctctgtgctttttgcataatgagttgagaggcttaacatttgtatgttgatcctcaaaacaaggttgcgtgatttaggattgtaaaacatgatgatgaatgcaaaaccatgaaatgaactgttacgttattgaagggaactgattcacatgaaaattgaaatgcctttctgaaaagattgtaactacctcatgaatctccgtatgttatttgtgatttattagcattgaaaaacatgtgcattgcacgatttaaaaataaataaaaagcaagaaagaataacaaataagaaagcaaagtgaataaaataaaactatccagacgacatgtgacgacgatcggacagttttaataatactatttatgagtctcaagatttcgagtgcatttggtttaatgttagattaaacagacacacattcccatgcacattttgtgaaaagttaaaattcaaaacttttaattcaacggccgtttgagacattccaacgttaaaccaaccacgcacttcaagcttatttttataatattattgacgcacctcaggacttcaagcttactcaattctgtttgtagtccattgtaacaccttatgtgctcagctgaatgttgatacttattaattttatcttattttatgattatgaaatcttaagaggaaaaaaaaatagttttaaactttaagctttagaaagcttaaaaggaaacaattaaaagaattgcccaaattccctatgacatcagttaaatatgtaaaaaggaaataatataaatagatcatataggatataaggtattctctctaattttaatcacccatttgtatcctttatgtactgacttagaacgctagagtctttacaagtacatcaccagaatttgctttgtgcgtgttgaagatattctgtccgaatattcaagatgcaagaaccggtgctgaatactactaaattgacgatgcaatgggtaattaagcctaaattaaaatacttcagtgtttttttgaggaagatacataccaaatcattaattgctacattatacatcattaattactgaaagcgtttgagtggcagatgtccctacatgagatgagtatgtgccctgtcccaaaacgcaaccaacttaacatgaattaaaaattaaaaattaaaaagctctgcactgtctaaggactatgatcaacttgaagcatgtaatgatttcttttttataagcgacagcatacaataactaaatgacagaatctaaaacaacatagtactttgacagcatcatggaatcaatttgaagaccaactcattaaacaatctattgatagcctctatgatttacaacattaatccatttcttgtactacaacacattcttaatcatattaaactaatcacaaccaattctaacaaaatctgaaacaatcaacaattcataatcaattctataaaaatctaaaaacaatcaagcactaatgcacagccaagaggcattgaaaaaacatcaataaaaataaaataaagattctcgccaaattcttaacccataacaacatttactacaaagggaaaccagaaatacagcaagtgaagatttcatccttaagaactactacaaggacaaacagataactgaatttattatttctcacagtcaagtcaagcattatgatacatcatacccctaaacaccaacaacagtactcaggtgagcagttattacatcgtactttcacatgaacgcgtcataaaggcagataaaagcaaaaatacatacaacacacgaccttaaggctcaagcacagcacactactatgtgacttaaacggtgacacaattcagcaattattcttaaagcactgcggatttgctgaatttgctcataatgttagagccttgttactgtagaaccacacattcttgtgaaccacccaccaccacagtagggtgttcgcttgtgctgactgcatcagcttctttgacactttgaacattgacatcctccaattcaccacagccaatggcttcaaaaataagatcattgacttcttgaaatctctcttgagagagggacacctctgcaagaagcctccaagcattgccttcagatgcctcatcataatccttcttcctctttagaaccatgtgcccactaatttcccacacagcaggattcacttgggtgtcaaggagctcagcatccacttctccaagagcttgtttctctgcataacactgttcatccatttggtaaatacccccacacaactaatgaaaatagattagacaaattcacttgcttcaagaattagtttacctgtggtaacagatagacttgctttccacagtcagagataagaacattgaaaggtatgttgttgttctgaagacatatacaggcatctgaaacaacatttgataaatcttccagcgtatcaccaccctcgaagacgagacctctaactggataattcaacagttcagatatcttcaccccaccatttaaacttgcaattttcttagtgggggccttctcaattgggaagggcagagccaaataataagcctgcatatatattcatgccaaaatcaccaaattgcaatcagatttgtagaattaaacaacggaatcatcaacacgaactattaagtggtataattgatcagcttccagtacctggaagtgaagatggttaatggttgcaaaagcacccaagctgttgtaacccaatcgaaaatatggattatcagcttccactgccatgtgaagtgcaaggaggaagctctcacggtcaatcctttggggcaaacactcgaaaatgtgcggaatcagcaaaacatgtccatactcgataggactgacctgttaagaaaatcgataaacaaacaaaaatcatcatcagttattacataaaacgcctaacaatgaacccacaagaacaaaagctagtgtctatacattgatggcaacaaagctgggagaattgtcaacatcaactggagcatttggaaagaactggacttgtgcatcctcgctagcttcaaattggaagaggacctcttcttgcccaactttggtaaagttgaatttgttttcatcaaagggttgaaggaccttgtcaactcggaactcagttggtctcttcttgaggtgacgaccctcattaagctgggcaacgaaaccatattcaccaggaataacctacaacagaataaccacaaaacacatcaaactcagaaatcataccatccatatatctatgcataggaagacaaaaacataacaaaacagaccttggtttcacaggcggtaacatcatagcggaaaagtcctttctgcatgcgatcttcccactgccatgaaagggtaaaaaaatttagaaactttaacacaaagggtaacaagaaaagatggtgttaacccttctccatgagcaaaattccatatctacctctccaagaagaagtgagtcgaggaatgtgaggggaggctctccggcgcatgcatgcagggccaaatcctttccattagccttcttgaaagcatacaaaggaagctttgcatctgttaacaaagcaaaaaacacaaataactaaaaaaaaaaaagagccatgtataatggatccaactcaactttagagagttattgatgacaaaaaaaaaccgtgaatgttacatgcacatgcatatatgagttggagaaagaaaaaaagaaagaagtacctggaatgcaacaagctttaaggcaattccgaccacaacctccgacgggacgaggagattctgcagcgtcgtctttttggtagttggaaacgacagtgggaaccctcttgagtctgagcatcattttgtgaacgaaagtagaagaagaagaagaagaagaaacggtgatcttaactagtcacaaagtctcttgtttttttttttttttttttttacttatttaagagtatgtaggctaaaagtaataaaaagagtgaagaaactagaagacaccgccaccagcgaggaagagcaagtctgaagggctaccaccttcagaaggcaaagcaccacgcccaccgtgcggcgaagggttggcggaagttacgcaactacccgtcctccgtcgtacagttgggacatgaatgagggagcgagagactcttagaatagccgtgatgtctgcaacgcttcaacccggggattcaacccaacaaaaataatgaataatcttgttttgcttctgtttttggcggaggagtcgttgttgagagaaccaacatgcagaaaagagtaactaactaaactagctctgctttggtggatgtggtgtgagaggatgaggtgcctttgtttcttgttttatagataagagaagagagatgtggtttaaatgtggccgtgaataatgcgtacggagtgaaatgaatgaatggaaagaaaaaaattgccttggtggaaaaataaacagagtacgatagaagagacaataattgaaagagagaagtggcttcacttttttgttcgcctcgctagacgctagtggaccactgtgctgtgctgtgctgtgggcgtaaccaatgggcgatagattaggtatttaggtatttaggttaggcccgtttcaaggaatcttggactccagaatcttctatcggtatattcattccactcatattttacacttaatcaaatgtataagtatgattaatcttctgttacaaatagttaataataaataaatgtagataagtgatttataatcttatgaagttattcaattaaaatgtttttataagaaataagtttcaccgtaatttttaagctcaaatttatttcttatattatataatactttatcttacaagtgattaagaatgttattcgttttagattgctgcacatgattaattacatgttcaaaatatggctattttttcctctcatcataagtagttaagagtgaagattattaagttattaaaatatctaatcatgattaagtttctctaacaattagttaatagaggatgccttgtacgatggactactaagtaatatggtctatggtgatggcagaagtaggaattttattgagggtacgaacataaaaaataaatatcataaataaaaatattttaaagataatacaaatataatatataaaatatgtaaggatgagttgatgaacaagcaaacaaagtttaataagtcttaataaaataattcagaatttaaaatcaaactcaaagtaataatatggagataaaagataaagaagacataatcagttttagcatagaaaatccaattggataaaaaatcacgacatccaaattggataatcaatccaatggacaactccactatgataataaataagtatctttaaatcctgatagagagttaagaatcagacttgtcaaaccttctatacgatctcataacaattctatcaatgatgcaaacataaacttgtaaagttttaatattatttggaatggaatgcatactataagcacaaaaatatgtttctatttatattaatttaagcatatgattttaaccacttttaaatataatcctaaaaatattctatcatattatgtgatgcaactttaaagatattttatattatgcaatacaatcttaaaaatattctatcctatttttgaatacaatattaaaatatattttattttatatttgaatataatcttaaaaaatattttatcttattatgtaatgtatttttaaagatttttattatattatgtaatggaatattaaaaatatgatatcttatcttttaatataatattaaaaatattatattttattatatttatattattcaatataatctttttttaatatcaaattatttttttaatttttaatatatataataaaatttatattaataaaattttaggaggatgtgagctacctgacctctcaatccacggtggactactttttatagtagtatgtaattacaatttaatccttgtgacagtgacttacttctatcctttttgcttttttattcatccctcatcgttggtctctactattctcaccatctgcaacctcaaggaaggactcactggtctcaccatcggaaacactatcgttgtcagtctcatcttcctccacgaaaatgacatcaaaacacttttgagagtccagatttcggggagggggaaagaacgactgaagagggagagagggtagcgtgtttgcgaaaatgacctagtttttttcactatttttggatgtcataatgctttgagtgataatgatatcttcatatttgttaaatttcggtgttgatgctcgtctctagtttttaatgtcgttatgtcaatggttttgaactctcacttttagatggttatggatctacaagtttctctcagtcttttagatgatggtgaatgcagcaaattgaagagagggaaagaagaagaagggaaaataaaacaaggtagtgatgacgctgccaatgacggcgcacagcgatcgagagaggaaaaggaccaaggaacaagaaaaaaggtggtgtgataaaagacaatataaaatataaattgataaaaatacttcattttaaccgtttaatattttgttaataaatattagtgaaaaattagttgtcaaccttaaaccacctaactcacttgatcaccttagacattgtggttaatagagccataagttattaaaatgtttaatagtggttgattttttcccttgtatgttaataaaaaaaattatgcatacaatatcggtaccaagtattcataagaatcaaatatgaagtcttatattcaaagggacaaaattaatactattagaatcaataacttattagtttataaaaaattaatgataattatataacataattatatataagcaatgatacttaacacccattaatatctcttattttatttctatctttctctttttattacatcataaaatctataatacctatttttacctttctttcactaattgtctaattttactcaaattatatatattcatatttatttactttaaactatttataaaacaaaattaatcatatttatgcatataattaaccaagtttttgggttgaacgctagacgtctaaaaaccatatgtacgttcaccattattcattttttctccactggtaccccgttaaattttcttccttgatggggtatttttattagaatataatggttgacctgtttgtttaagttttttttaaattattttttttaataaaaatcacttttttttttaagtttaagcaaattatctatatgtattttttatgcaattttttgacaccttaataattaataaattaaaagttattgtcacgagttttaacataattattcaatcggtaaatttattatatattatatttatgattgaaaggcataaaatttttatggtataaatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttatcatgtaatttttttttatatattctttgtcttttatattaattagattttttatttgtatattttttattttctcactttacaataaatgattaaatatataatacaaaatttaatattttattaatattgtaaaatcacaatcaaaatggaaaaaaattgttaaaatgtcaaataaaataggatgaagggagtatagatgtgccaatcaaccattagtattgatttagatagataggatgaagagaaatactaataatacacttttttgaatataatattttttattagttgaaattttaaatttccaaaaaatcctttttaacttatttttattaattaaaatttatctaaattacaaaatcataattatttttcattaaataaagaatatgataaatttcatttaataacaaaaatattgcatttaagagaatatattcgaataatgttagtagcatttctcttatctagattcataattacccaccgctgaagtaagatttgggatgctaaaaaaactttatttttgtttgaaaattagaagtactagtaagataacaatccaccgatcgaagtgtttgcagctactaaatgaataaccaatcccaattatgctgggaaacaattctttattttattaatttcttaattacagccagccttttactagcaatagcgtgttttttggtcttgttcgtggtaccaattccaaccccacgtccccaccacaattctctttttgcgtcaatatttttctatgaaatattgccaaagggttttttttaatcaatgtttgcttttttggaactagtaaaggaaaatgtattaaaaaaatatattaaaagttatataaaaatgtatttgtaaatgatagaaaaatgtagttttatgtattataatataataatcataaaaatcctcttttactttctcaagtcacttgttactttgttagcacatttacctattggctgaagcagtaccacatgaactttcgcaacaagtaacttatttatccccatgagcctgctaatcacgtattcacggcttcacgcatgacgtaactcattctcgtggatttaaaatttatactgaaaaacgtggaaatcttgctttcctgtggacgaaaagactaaaagaagtactataactatataatataaatggtaaataattatttttttcatgaataggtagagtatggttaaatttatttttaaaaaataaaaatttaaattttagtttttaaaaataaaaaaaatgtgacaaatttattaattcgttaattttcgtccgttatcattaatgaaagagtctagttggcacatttcagagacgaatttatctgcgctttacacattgaaggatgaaaatgactatttatcaaaaatacaatttaatctttattttttttaatcatcgcaaacatagcattacgacaaatacttaaaaataggaaagaaaacatatattagaataaatataataataagtataatattaattaataaacataatctgtctctgaaatttttattatgacaatattaggtaataacaaaaataagttaggtttcattagcataaatttttgtttgagtctcatattttgtgtaaggtattgttatattataaatttcagacaataggcaaattatatttattaatatgtttgttctaatttatacttattttttatttttttaaagtgtttattataatattatgcttgtaataattaaagagggaaagataaaaattaaattatattttggataagtagttattttcgtccttgaatgtgtagtgcgctaacaaaattcacccattaattcatccctaaatatgccatataaactctgtcattaactatacaaaagttaacagatgaattaatttatgacacttttttcacttttaagaactaaaatttaaatttgatttttcatcttagataaatttataacactttatatattaagggacaaaatatctatttaccctaatataaaatatggttaatatgatttacagtgtacgtgaagttccctcaagctcacaacgatcatgttaactttgttaggtttttccccctctaactttgtttataaattactttcaacgattttttatgctgttatttttatgtttttcgtaaataaacatttcaaactttaatgttatcccaaatatttcacaaacttcagttatcgttcatttgtgtttttcttgaacttttattaaattttcctggtcatatatctatttgaatatgagaattagcataaattaattctaagattaagaaatgaatttttttaaataatcacttaaatcaaattgataaataccaccagtaaatagaaaaagttgttcataatttttacatagttctgtactagagtctccatcaaaacctttttcaaccaatccaaaaacatacgtttaacttgagaaagaagaaaagaatgacgcgttaaaataaatacacgtaaatcttctctcacgcacgaatataaattagttttgtatataaaaattataacattttgtggacttgaagaagtcttgctgtgtatatatacatatcttgtctatattgaattttgatgacgaatttgtggcaacctaaaatgcgtatgggaagaagctctgaaatttctctatctctaccaacaaacagaaaattccagtccatgaaacttcgagggtgaattgaatggccaccaaaatatctctttttattaatttctgctggtcctctctgagcccacaaacacaatcctccaatcctcaacccatgtctccacatgatgcatgtgtgcaccactgaaaagcacaaagctatacactcacgtgagaggacgtttgggtgttgaaaattaataatagaccaaattaattctcctatttatgatgttaaattaaaacagacatgaaatggaagtcaaataagtgtacgagcagaaggtaaaaagttttctcaatgtatatgtaaagaagaaatcacaagacctaatttattaaaatattttcatgtttttcttttgatagtagaatatcttttaatcttatctaataagaatgatttaccataatactatactatcttgggtggatgggatatgagatatcaagctctaatccacaaagttttattttatataaatagcaataccaatatataaataacaattatggcaaaaaatgagttgagctcacttgagtttaacttgactaattaatatttaatttaatctaaaactcgacttgagtttttattagctaaaatttgatttagtttaaactcacgaataacttgattcaactcgtaagcttaaataatatgaataatagtccaaatttttaaatcctatacgttttgaatttttaaattattagtagattttagataaaataattatttgttttttaaagaagaaaaattgaacgtattctattagttttatagaactataagatataacaataaaaaatcataattacaaccaaattaatataaataaaactatttcatcatgcatatataaaataatagaaaattcattcaattatataatttaatatatatgtgtgtgtgtgtatggagtcaattcatgaattaaatgggtaaaattatatgtaactcaagttcgactcatttatttaacaagctcaaattttagttcaagttcaactcatttaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttgacccatttaacatgccttgcctaacacattcagaaagaaattttacttaatgtctttttttgggtcttattagaaaataatattttccatcaatcttttttttttttttttccttttgaagcttatttaattcataaatttacattatagtttgaatataattcacgtttgagcatattgaatttagccctgctatatgtctcaactttcgtgtttgccaacaatggcaaaatcctagatcaaaacttgggtcgattactagctagcctcatattccaattttgactcactcaagtatcccccatgcacgagtcttgtatgtaaaacgatacttaaatgttatgtggatcacactctcccataacatgactcttcttattgtagatgctttgttgatgtttatagactacctaacatatcatctcttagcctccatttggtaagagggaaatagacaatttcaaatagtgtgaatttcaaattttttatactctattttaatttaaattaatattttttttcatctccttcactaaacaaaacattagacttctacatatatactagcttaaaatagtaagtgtttgtgaaaataaaatctataaaatatattagttcattatatattataaataaattaactcataaaattgtctcctattttatttccctagtgtgatgtggatttgaatgaatgatgtggggggactagggagggagtacagaagaaggcagaaaaataacgtgcaagattaggcatctatgaagggatcattcttatttcttaagactaagaaacactcttttttgtccgctcccagactcatagggaccaagacaaagacaggcactgccctctgtttggaggcttaaccttaacgagtccacttttcttaacttgcaattaatattaatataaggtacacttcgtgagacatccaactttggaattgagtattcaaaccatagttgttacattcgaattttaatcatcttatctggtgaatacattgaaattacaactagatttcatggtcgtacgatatactgctgcaaaaaaaaaatgtaatgctatttttatattattaattatatacaaattattaataatgatatgactttaattttcatatattgtcaatgcaaaataacattaaaaaaatgacaacttttagttatttgatttatttcatttaaattttattattttactatataaaataatttaccctccattaaataattaagggaaaaaactacttatttagtccttatacttgtacaaattttatcttctagatttcacacttaaaaatcctcacttttagtccttgtatatataagcacttttatatcttttttagttcctacttttacggttatacaaaatttaccttttaatggccttattattttttaaaggtagggactaaaaataatccaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaccaataataactatggtgttaaatgttaaagatgaaaagttaaaattaaaatttaccattgttgcttttataattttaaagtcattgttatgacattttccaataaccatgatgattaatattagccacattcttatatgcgttccttatcacagttgtggaggttctttgatcactgttagcgtcgtcatatcgctatcgtcatttggcattgacattgaccaccactgtcgctggaattgtaggaaaattggttttttttcttcttctacgtaaaggtgataactcattttctaaataaaaagccaatcaaccgatggatttgagtattaaaattctaagattcaactgaaacgaaaagaaaatcaaaatttatgcgggccatagaattttattcaaacatttgaatgcctatggagatcctaatatcgtcaataccacttattaaataggaatattcttttaaaaaatgtcgtgctaattcgaactctatttaatcttgcttctattaaaaaaaatgtttcaatttttacattattatttacgaactgctaattaaaacgttttctttcattagaaattaaattccttttagaaactaaattctgaaaacgattacctttgaaagatacctgcttcactcatatcctcatcattctctttccaaagaattttttattattattggagtgagcagcaaggagcaagcacgttatcttttatcaaaattttctccctatatacaaaaagacttataaaagctaaccagcagttccctttataacaagccgaaagacttcaaagacatgtacgaagagaagaaaaagggcagaactttagacttttcactttgtaagagctaaccaacggtttcaataggatgcctatgattggccaaggccacaacggggtttttagagtgtatatcaataatcctcaaaggcaaaacttaatgcttctggaatttatgttatggacgcataaataacatttaggtgcttcaagttggacgtgaatcccaaacgccaaaagctaaatgaaacatacacggaattatgcacaattttgatacttcaattatggattcaactacatatatagtgttatggaatatgaaaaggtaaaacactggcagactttcattaatgagtatgaacaaatagttcaagtaaacttaacattacatctaagtcaaaagcttaaaacattaaattggtggatccttttcatgttatgttattcaacatgtcaatttatattgaccaataaatatactcacacttgtcactctaacaatcttcatatgaaagtatgtgagtccctttcacattatatgttcttcttctcaaatgaaactctttccatttttttcttgataacatgctccatccttttctcattttttagcttgtccatgtctctcttatagggtgtattacaagtttcattatcattattgtacacacaaaaaagtctcattagttaataaactttggacacttcagctggcttaagaataaatgactctggttaatgtgcatacaacactgttcataatatccgtggtctaacctttcatttctaaaatccttgatatcaggatgtttacctttaaaaaaagcctttgaactatccaaccgtacattattaaacctttgttttgacccaccaaaaccatggttaaatagggttaatcaggatttaacttttgggcttcttacgtgtaaaaatggcccaaattttagtcagtccataacagcaaagaggaaagttgggcttttccgtgattcttagggggtccaaaatcaaaatgtcctaatcctaccctttaattaacagttctctggggtggaatcacataggatcagaaccgtgggacccaccactccgacggcttttaagaacaggaccaagagttcaaagagaggttaccttcttcccttaaaatcatatcaacgcctacaaaaaaaagtgaaaaccttattggaggaatatgctttcacaggccttatcacgcaacatccaaataacgaccatattaatttctctcttgtatggttccctttgtcccttgtttttgttttgtttctcgtctaatcactgtgtaacaagtttaactcctaggctataatctcatcttgtcacagttttgtgccaaagctcaacttaatattttgttcctaatgtggtcattcggataaaatccataatcaactacacgacagtgtaaagataggaaaaagaaaatgctccaagtggttgtgttgtgtaactttcatgtgccgacattgataacgcttttaacagttcacaacatcatgcaattggtttgcaattagtaaatcactaaactagatctatctggctttaatttccacccgaattggattaaatatttcattaacatcaatattggtggacaatgtagaatcgaactacttttatcaacgaaagacaaaatattgagtgaatttatttaaatttaaaaaacaattttaaaatgtttttttaagaaatagatatgattttttaaaataaacagaaaattaatttttatttaaataaatacacaaaaaaatagaatgatatttattttattaaaataaatacttatttcaataaataagctcaaacaaacttattcattattacttgtttatgttatccatttaaataaagaattttttattaaaataaatacttattttaataaataaatttaattaaactgatccattattacttgattatgttattcgtttaaataaagaagaaagaatagttataattaaagggtattacacaacatttaacaaatattgcatcataatggtataaaaatttcactatattcgtatgtaaagaataatatatatgtctcatttcacaagtaggattaatcttttaaataaaggattaaaaaataactgggttctctccactaaaataatattgcactgtaatatatatatatatatatatatatataaatatattgcctatgatgtttttattgactataatgtgtgagagtattgttggaattttcagcccccacaaatatttttgttgttttgttgactgacactggcaacaactcatactctgatgcaagtgactacttccactgtttgtctttctctccctcacctctatttatatgtccagaaccccatacacttattcctacgtattacttcctgctacccctaattattcatttattctgtccatcttttttattatttatttcattcttgcctcttggccactttaacttcctcactcgcattcaccgaagtcatgaacaaattcaacaaatctgaacttctagtgctctttgtccttgctcttctccttgggatcacacccttgttaccttcctgtctgagaccaacctacctttacttcatctttaacgttctcatcattgcacttggagctgaagctggtcttctctcagttttttctaagcctttagaagacaaaaagcaacatgtttctgtcacccagaaacctgtaatgcccccagaagtgtatgaacctgaggaaagggtggaagtgggtgcctcagaatatgatgaaaagaagcctaaggttgttgaaaagcctgcttctgatgagaagattgttggtgtcactgaggtgaaaaagtgtccttcaatgccaaatcttttgctcataggaggtggagaaaatgaaggagaagtcatggatgaggagattgaagctgaagatgaggttgggggagttaatgggcaagagctgtttgcaaaagctgaggccttcattgggaacttctacaaccagttaaagatgcagagagagaattcttggctttatcaggaagccttttaggaacgcattagctttttctctctttaatctcttgaataaattatttccagggtgttaaatttagaaacactggttctgagggtctattagtttttaacccactgggtttgtacagattctaatttggaattagaggtcaggtctgtttactaatttcaatctgtattatcatcttctaagttcctgttaaaagaattttactgcatctattttcatgctccaacaattaaaaagttgcatgtcattgaaacatagcattttctattgaaaataaactgtggtgttttttttcctgcttaaattaatgggagacgactgaagagaataagaccgggggaggctggaaaagtaattggagttcactgtcggtaagacatgacatatataattgtatatttgtaactggatttctgcatgactatcaataattgactggggtctgcgtatatgattatgatgtatgcttcatatctatcgtattttataaagtacaagatgcagtatacagattatgtgatatcaattcatgcatcttgcactcctaaccaaatgtatgtataactaatcaaactttgatgctgtttaactcatcaaacttttaagtctactttagcctcttaatagcaaaggtttgcacaaactataattaagtagttaactagtaagtatcagttttattaataattgtttatagtattatgcttaaggaatcaaaagtagaatttttttaatgttattcatatattatttttgtaatttttaataaagaattatattagtttaaccattactcatggttattagtaaaatcaattataaattactagttttaaagagttcttggaaacgtattctcactaaccattaatgagttgaatgcactacttacttttaacatgtcaaaatagactagcttttagttaattaagcacaaaattgatctatcagagtcacctagtaaaaataaaaattacataagaatattaattctttagctctatttgagtcggtttccgtttttctcaagtcatgtgataactgatgacgtgaccagcttatgggatatcttattaaaaacagcatgttggatatttttccatgcaattggacgaattttttttcaaaacagtgcagaattctgaaagtgttacttcatgcccaaaataagtgccaggtaatgtttgatagtgccagctgcatataaaaaaagaaagaaagacgacgagtgttcaatttgacaaagatcaagccttattttgattatacatctgtcatgattctgcctaatccatcttatcaacaatatatatacagaaaaatatatgatccaacttgttaatacccgttgctcaaactaaacagtggacagggtctgaatctaatttggggtatcatgtttctgtccccgtaagaattttacaaaagaaaataaaaaattgacacaatgagaaagcatttttatttgtacgatttttgttaatatttaaggttgctaaatgctaatggcaatgcactcatcctatgcatttactcgctgtgtccaattgtcgtccgaaaaatcacaaatatttttcttaacatcaagaacattaattgttagataggtttatagacccctgtctatttcacatgaggtaaacatgttatgagatctctattattttttttattatattgtactataaaatatttatcaatattagtaattaataattaatttttgttaataaaatattctctcgtgatcatattttatctatttattataaagtttaaactcaagaccaacacaatgttggtaaagacccatatcattatttatatgatagtgagacataaatttaaaatatactagatgttagagacacagtggacgtgttgtgtatcatcttgttgcataaaacttcttatatatatcaatcaaaggaatctaggtttaccatctcttctgaaatagttagttggttaccttagacgcggccttttagataaataagaatatatctattaacacattatctcttcttttttgtgtgcgcaaagaatcaaagaatagacagccaaatttgtccaatgacaggcactgcagcagtattagaatagcactaaatttcaatatcttactgcggcagtattaatatgcagctcatttaagaggttgacaaatacaacactcagcggagtgtggagatatttttgcactattagtaatccagaaaaacattaaatttagaaattcaacattttaatactctactttattttttgacaaaaagaaaaaccaaattacaatagtaaaattatattagtgtgcacagatgcacatgtcatttcatttaggttggtgacaaccaaaaccttactaggttgtaagtttctttgccccttttaaagcaaataataagttgtaatatttcacaacctttttttttttttttttacagaaatctttgacaactaataagaatacaaaattttgtctctttatctagctctctaaaaataaaggcattgcgtagacattatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataataagttgtaatatttcgcaacaattttttttttttttttacagaaatctttgacaactaataagaatacaaaattttgtctctttatctagctctctaaaaataaaggcattgcgtagacattatattttggtatttcctgtggggtcaatttaccttggaatgttgcttgagaatctctttttttctgtaagacgttatcctttagattttttgttttatcttaataatagggatatggaaataagtttgattttatttattatttaatttttatttgtgtaataatagggaattggaatttgattgcctatggtccaaatacgaactactgcatgctgaaataatttgaatttgaacggttctgatttgtttaaatacatttaaaactatttttaattataaaattaaataacttggatgaatgagatatagtgtgtattctccttaaaagaacataggttgtgcgttacaaaactaaagatgaagtattagacgataattcaaatatttgttaactgataatttatgggacaactttttcttttacataaaaatgtttaaatatatttttaatctttgatatatatttaaattttatgtttgatccccaaaaatttatcttttatatttattttttgatatttgaaaaattttgttttaaatctcgacagtcagttaagtgataatgtattcgttaaatatttgataacacgatttgtaatgactcaaaaattatcaatgtttctttcaaaatcaaatttaaaacagatctcaaatttttttaagtaaaaataaataaatctcaatttgttataaaaagaatgtcctttccttctccctcctcttccgtgaccacctcctcctctgcgctaccaccttcaaccactctcgtgtcctatgtgtctccatcgacgtcgatccgtaatgggccctcactctgtcaccaccgtgggcttctgccaccattgtcgcatgtcccaaatctccagtgtcagattcccgtactcaccttcctccaccgagaaccatcgagggatacgcggtttgaacattgtgttggaataaaaatgattcatgctctcacaaatggaattgttttgaagaacgaatggcaacttgccctttcaatttggacagtcacgaattctggcaatgacttcaattgggtgttcaagaaggggttccttgtttgcagcagaattgggattcatagaatggtgtgttgcacgctggcttgatgccaatgaaggggtaagaaccaaatctgtattcatggcacgacacgacgaaactccgacaccgacgcaacaatgaccactcatccttcaactccttcatcatccttcacaatgacagacgaaagttgcggtagatctggattcgtgtggtgcaacatggtagatcttcgacaaggccacaataatgaccgatcccccttcaaccctgtcattgtcctccactacaacagacaaaagttgctctagatctagatttgtgtggttcccaccatgttattgttgttgcaatggtggaagtggttcgacaccgacgccaatggtgaggaccaaattattgttgtttgatttatttattttttactttaattattatggtgattcttaattgtcataaaatttaaatttgattttcaaataaatactagtgatttttgatccgttataaatcgtgttatcaaatatttaacggacacatcatcacttagatgacagaaattcaaaacaaaacttttcaaataccatgaagcaaatgcgaaagaaaaatttgtcaatgatcaaacacaaaattcggatgtatatcatagataaaaaatatgtttaaacctaatgaaaaatacccatcaattttgacaaactcctcaaaataaagaacgctcaacctataaaattgtttatgttgtaagtggaagtgtggaaccaaacaacatcataacaaaatgttgtaatgtgatttaattttcttatagtgtgctattcgtcttcttttaataatatgaatcaaatgcacccaaattcaatctcaattttgaaaaaccatatcttctactatgtatttcttaagacaacgatttaaatgtttagatttgtttaccattttttttggtaatagaataaaacaatttcaatagtgagattgcatagagtacgttttttaaagattaattatagataatgatgaagtcatcatcatcaattaaaatgcaaaatattctttcgttccttcgagctagaaataccatttccgtttgatatgtgtggcatttgatggtttattttcaccaatattcttcaattctcttgcatcttcaaagaaaaccaaaatttcatattaatttcattcattcatggtcccatctcaaaaacattggcagatatgacaaaactaaattccaaagtaaagattaaccttatcttctaaagtctaaacaataaatgaaggtaaaaacttacaactaagatttagatttcgagcttccattcgcatccctaaggtccacactcacatcaagttggcagtatttgaagaaataatagaaaatcaaatgtataagataatcacgtacgatcacagctttttggtgagaaaaaagggtgttaggagcccgtatataaaactgcaagctaaactgaataaaataacagaactagatatatcgacaaaaaactaaattgaaataaatgaaaaaagacaattctcacatcaaagatttgtctttttcttttctgaattgtggagtacaagaatagaattgataattgagttcatcatgcattatctaaaatatatataacaatggagaccgagcacaatctaagaactcatatccattcttactcaatgtgtttgcaagcatgagtctaaattaagtaactgcaaaagattcgacttgtgtgcaagcaaaagagacaagtcttgtgtgtgcaagcaaaatccattgaaggatcttgtgtatatttttagcatgcagatcatttgtagcctgctgcacaatgaacaaaacttctgtttttcgatttaacaacatatgaaccattgaatggaagaatctacactaaccagagatgagagatgacttgatgttcggttgagattttggatggaaaaaaattgtgcaggaaatgcgggagagtgggagaccatccgaactacatatatattaaccatccacttataacatactactatattgaaagtttattaaaaaattcataatcctaggctagaaattttaatttttttacaacatataaattctaatatttaaattaattaaaataatgatattaacaattgagaataaaaaatcattattaatacatttgttttaaaaaataaattaaaaaactattcctaattttttcaatattttagatttaactgtgcagtcagaattttaaaattctaacccttattacattaaaaaatactaacattaaaaaaatactaatgtactctttcaattactatatttttaggaaaaagagtatttaggcaccttaaattttatctcttctacaaatagacatattaaattttaattttagcctagttgattcctaaactttatcaagataccatgaacttaaatttcgttttaatcttcttttttttgtgttactatttaaacatggatttatgtatggttggaggcctttgagtgtctcttctaatttttataatccttgagtttaccgaacatcttatttgagtcaaagtgaaaataaaacaattaatattatcagaacaatttaagacctacaaatgagaaaacaaataccataagagaaatatcacatatctaaagctaagttaatgaccaaagattagaggggaacatgatcaaattaattaatgattaacatgtggacttaactgaggatgattgtgcttactaaagtgaattggaggatcaagaaagttcttgaacattcctatgtatgtttcacaatccattgcttaaaatgacatatacatagaatagtttctttataaaagacgaaaattttgccaccatttttataaacgtttattgtaagtcgtccaaattatgttgagataagtttccaatgattaagtcctaactccgacttggcaggtccttgcagaagtggaacacatgtcaaatgattaagcacatgtaaataaagcaatagatcgaccacaaaataaaagctgggacttcacatgtaattgaagcagtggaccacaaaataaaagtcataatgtcactcgcgttttaagaataaaaactacattgtaaagttccttaaatgtacattgtttctacattaaatagataaagattatccgcctttatactcaagagccattgtgtgcatgtttggattccaaataaaattgattttagtcccaaaaattatggtgaataattaaaaatgaagaaacaatccaaaattgttttgcttgtgagttgtgacaatggaaaaataagtaagatgtgacctacccaaacacgcactgacatgactagatttattatcgtgtatgtacgggtatattatatttttttaatgtttttaaattttatttttataataaagtaatttatatcaatactttttgaaatttcataaaattattttactatatgaccgttaatattaatttataatatatatatatatacctatttctgaatattttattattatccatttgactttttttgaaaaacatatttttatagaatattaattaaatatcaaatttatttcataaaatatatgaaaaatctatttatttatatatttatattaatattatactgataatatcaaatgttatatcaatattgtttgtcaaatatactttattcaataatttataaattaatatattcaaagtcaatatatatatatatatatacatttaattttttttgtgtttaagctagttttatgaagtaattttataaaatatcaattgattataaaaaaaaatatttcgtctttttatagtaatttttactgctgtaattatgtcgtgtctgattttagaaaaaaatcaaaatatattcaggtaattaaaaaatgataaatattaaaattcgcctataaaaatgtatgacattgatttttaaaagataaaaatttaaatttaaaattcataaatgtaaaaaatataacaaattaactttataaataatgtgacagtaaatcaatttttaaattttataatttaatatcaaattaattttaaaaatataatttataataaaattaattcttaaatattaaaatttaataaaaaaaataatcttataaatttaagagattaatttatcatattttttatatatttaaaaattaaattcatatttttatctttcgtcacacttttaaaattatatatatatataaaaaataatctggaaggacttataaaaaaccttgttggtgagaagtcagagagtgtggtgtgagtgagtcagagagtgtggtgtgagtgagtattgtgttgtttttgtttggttgtggtgcggagatggaagtgtgtttgctggaggaagtagagaatatcctaaggtacggatttcgaaacaggaagattctagaagaagccctgactcactcctccttcgtggacgctgtctcctacgagcgtcttgagttcgtcggagaccccgttctcagtctcgccatcagcaaccacttgtttctcgcttaccctcatctcgaccccggccaactctccctcctccgcgccgccaacatcagcaccgagaagctcgcccgcgtcgccgtccgcaccggcctccaccgctacgtccgccacagcgcccctcccctcgtcgaccaggtcgagcgcttcgtcgacgccgtcaagctcgagaatcaccccgtctctcacggcggttccgtcaaggcccccaaggtcctcgccgacgtcgtcgagtccgtcgccgccgcggtttacgtagacgtcaatttcgaccttcagaaactatggatggtaccgtaccttttatcaattcatcatcgcctttatgttagttgtatgttagtttttctttccttccgccctccctttttctttcaccgccaagctattcttatatctcctcgttatcacgtttataacaaatcagataaggttttaagttgagtgcttgtgctctcgatgaatgtatgtaaattattattttgattatttgataaggttttaaattttgattgcattccaatagaagatacttgtggtctagacaaaatattgggaaaaatccaattcgcacgagccagagatagtgccaagataaactatataagtagagaataaccctcatcctatgagataatttttggggttgaattggatccaaactcacattcaagtccaaaggtgctgggcggcttgtattggggaaaactcaagtcccacgatagattatataagtggggaacaatcctcaccctatgagctagtttttggggttgaattaggtccaaattcatattctaagacaaaaagaattgtgattgcgatttgtgctaaccaattcattatgatgacacctattataaatgatttttagaataagcttttacttttacattgaagttgcggtacgattcaagatgatgaaaatttggtttgtgattgtggcagataatgaggggtgttttggagccaatagtgacaccggatgttttggagaaacagcctcaaccagtgactatgttgtatgagatgtgccaaaagaaggggaagcaggttgatataaaacagtcaagggaaggagatgtaagtgttgctaaggtgtttgttggtggagagtttgttgcctctgcttcctcttctcaaaaggatcatgcaaagcttgaagctgccaagattgccttgcgtaaactcgtacatttgatgccttccaccgttaagaagtctgccactaacatgaatctcaactttactgttgatgaaaatggtaccttggttgttgaaggacccaaaaataaacttcgtgatatttgtgcggttaaaaaatggcctataccagagtacatgtactgttctttaacatgattttctttcagttcagttgcatgcgtgatcgaaacttttaacattccttgttgactaacttgttgcatctcttcaatggctcacagcattgaaaaggattcaggtccctctcatgaaaagaaatttgtctgcgcagttcagattccaactgctgatggtattcttcaaatgtcaggggatgaaaaatctcgggtgaaagatgcagaaaactctgctgcttccttgatgattcaggccttacagcagtctaattatatgtagaagagaatggtgttgtaattttagggtgtcttccatcttctgttgtgattggctattgtttagaccatagtgcagcttggcatatgaaatcaaggtttttttctttgacaattttttccgatccatatgaaatcaacttttcaaccttcttgtgacatctttccttttgtgaagggttgacttttcccatgtatagttttctgatcaagtagagcttcctattctttaattatttaaaatctaaagactcaaatttatgtttagatggagagtgaatctggaccactcattggtacctaagaacctaaaacctcaatctattttctcatttttagttcatgattggctgtgtatgttcttggatgttttatattgtgtgtttagttgtgatttgatcaaggaggtttcaatgggttttgattgaggagattcttctattggtcaactgaatgatccaattggttcttcactcttatcttggtgagttttggacttgtttggattgatgaagagaaatagaatgagataaagtggaataaaattttcagtctattggttgcatatattataatagaatggaacaaaattttcattctattatttggaagaaaaaaatgaataattattttactctcatattatctttaatctctaacaatctcctttacccatagatgaagataagttttttatttttgaaaaaaaaaaaaaagtccattcttgataatctcatctatttatctttatttcctgtgtttactggagttgctcaatcactctctcaacatcatctttattctttgattgcttgcaaaccatgccaaggtatcgaattttcatattaaatctacgtaatttccatgatatttggtagctgagtgtgtgtgcggcaagttagagaggaatggaaggaagaataagaacgtagcgaaataaaatactgaaaaatatacctgtcatgaatttgaggacaagccacaacgtggagcaaaaccattataatcatgacgttgagagagaaaaatatttaccgttccattgcatacaccccaatttggtgaggaaggaaaacggctaaaattgataggattggatggaatgggttccatgactttcctagtctattccattgtttatttttcaatacaaacaatggatcttaatcccactcttccatctactcccaccaattcaaacaagggattaattttctacactagccatttttctaatacattcaatatatacagtataatatcgattttatccttttcgtaatctgtaaaataaaaaacttatattaagaccaacagttcaaaagatgaaaaaaagagagttcttaaatgacatccctccccaagttcacatagtatccatttatcttatgccaagaccactctcctcagtggtaatctcattgatcagataaatggtatgctaattgccttacacctcctatgtagcattgtattggaacatgcttcacatgcatacatgttcatcatacatacccaaaaaaaagtctcagaaaaatgaagcaaataaaaatcaagtttaattcatccaaataaaatattttatcgaaccaaattgatttaaaacaagattagtaaacttacagtttttgacaattcaccgcctatctccatactgcgcaggcacagcggaagaatctctgttgaaataaggaaacttatagctgctgtattatcaacctggtgaaatatcaacagaaaggaaattaaacacatggcaaaactcaagtataaatgtacatgtgacaagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaatagcttcatcccactaggaaaaaaaatcaacaatatcttgaagggcataaaatagttcggaaaattttgttccctgatactagcgatgaactaatcctaacaagttgatttgaatgtacctgttacatcatagaaaattattacaggaatcaatttgaaacttaacaaatagttgaaaatctacatgaacattataagattataacaagactaattatttgtggcaactaaaatatttacacatctacctgtgtgccatagatttataataatcaataatcagttattactgttttttaaatgacatattagttgaggttattccggtatttagtattttatggcaaggtttattgtgacaataatttactaattgaaattattctctgttcagcataaatgttgtataaaaaattattcttctcgtagtctagtgtattcaataacagaatcagcaaggacgtagcaccttcactaaggtaccgatgactccaagactggtaagcctcaaatactcaaatggcttggcctcactggttgtattaaggaagggatacagatatagaggtatatgagctgcagatgacaagaaggtaagtgtaaagagtgaacagagtaatatcttttcctttaagtgttagtttcaatgagcaaaaaccctgctgaaacggatatggtaatgtcaaagcaatctccttaattttatattaacaaaagaacaactaatatgcctttcaattgcccaaaagtttctttccatggatgcttatgaaagtatattgacagtaaaaaaaaatataagtatgactgaatgctaagaaagaagaacaagtggtatgacctttaaattgaaagagagaaacttcattttctagtaagataaagtagaagtcctatgataagatagagagagagcaagttgcatataaaatttgtctgcatgattctgttttatatgcagataaatttttagattatgtatgatcttttaatatcaacatcaacaatacctttaattcaagttaattagagtcgatggtagataaattcaataataaatatgaaaaagtaaaggaaggggaaaggaaagaaaaagggtgaaagaagaatgagagaaatgaatgcaaaagaaaatttataacaattttaaccatctttcatgaaattttatagtttaacaaattattttttactttttaattgttagcaattggatgcttttacaatattttataacaattttaaataaatgcaaaagaaaaattattagtgagaaaaaaaaaaggaaaatatagttaggagatgataagatatcaacaatcattttatatttatggaaaatataattaggagatgataagatatcaacaattattttcaaagatactatttatcataaataatattatttagcaaacagaagttcacggtcttcagatgaataagaaaaaatatcattaccatggaggaatatcatccttgtatcaaggtgagatgccacacactgtaaaaaaatccatgcaaaagatatgtgttagtaagaatgcattgaagaaaaggagaaaaagatacgacaaagtatatgtgactggaccatggttctaaattgcacccgaaatattgttgttgcagtgttgtccgcaacctgcagtgtgaatttcaatcacacaaaattccgcaacgcatctgctgccacctagccacaactgaaccgtattggagcagcaacggaacctaagcaccgttctattccacttttttttgtaaaaaaataaataaataaataaatattcattttcatttctgaaagtgtaaatagctcacaaatccattcctgaaaaatggaaattcaaatttctgttgatgaagtgaaaaaaatatgacaaatttatctccctattaattttcatctattattgttaatatttatggaccaatttgttaatgcactacattgtaaagttacttaaatgtacattgtaaagtcataatgtcactcaaagttacttaaatgtacattgtttctacattaaatagataaagattatccgcctttataatcaagagccattttgggcatgtttggattccaaataaaattgattttagtctaaaaaattatgataaataattaaaaatgaagaaacaatcaaaaattgttttacttgtgacaagtaagatgtggtgacctacctaaccaaacaagcactgttatcatgtatgtacgggtatattatatatatatatatatatattaatgtttttaatttttttataataaagtaatttatatcaatactttttgaaatttcataaatttattttgctatatgaccgttaatatttatttatatataatatatatacctatttctgaatattttattattattcatttgactttttttgaaaatatatttttatagaatattaattaaatatcaaatttatgtcataaaatatatgaaaaatctatttattcatatatatttatattaatattatactgataatattaaatgttatattaatattgtttgtcaaatatactttattcaataatttataaaataatatattcaaagtcaaaaaaataaaatatatatatatatatatattaatatacatttaagttttttttgtgttcaagctagttttataaagtaattttataaaatatcaattgattataaaaaatgttttgtcttttgatagtaatttttactcttccaatgtttggtgtcccagaactcttccacaagtgggccttctgggcccaaagccaaggccttttcctcgctcagaaccaccgccaaaatctccacacatactgattcacacttactcctctcttatttttcatcttttctattatttttttctatacttttcaatttctccttgtgcaaatatctaagctattttttttattttactttattttattattataaaaaaataatccaaaattttttaaacatattcttgagaatttaaggggggcactgccccccaatctataacctgcgtccgcccatgctagggtgggcaacatccccctaaaattttattatatatattaaaaattaaaaattaaaaaagtaatttaataataaaaaaggttatatcatatgatataataaaatataatattttttaatattatattaaaaaaagataaaatatttttgagattgtattacataatataatataatagaaatttttaagattacatgcctaattttttaagattgtattcaaatatagtatagaatattttttaatattgtattaaaaataggatagaatatttttaagattatattgcataatataaaatatatttaaaattatattgtataatatgataaaatatttttaggattgcattcaaaaattggttaaaatcgaatgattaagacaaacaaatattctttctaaaaatattattgataatttttaatctggttatccttgattattttatcatttttttttctttagattgttctattattttttattttaatacctttgctacaaaaagatgtcttgtgtagttatattcaatgagagcaagatgtcatgtcccacctattcaatgagagcaagatgtatgacaacaagatgtcatgacccacctattcaatgagagcaagatgtcatgacccgaacctacccaaacacgcacttctaaaaggaatttgacttggttataaaaagaaatctggaaggaccggacttggaaaaaagtttgtcgatgagttgaagtgagacagggtgagagtgagtgttgcggggcggagataagggggcgggggctagaatatatcatatgatataaattttattaatataaattttatatcaacatatttccccttcttttggcacatctcatgcaacatagtcatgaggctgtttctccaaagcatccggtgttactattggctccaaaacacccctcattatctgtcacaatcacaattattttcacaaaccattttttcatcatcttgaattacaacttcaatgtaaaagtaaaagcttattctaaaaatcatttataatagttttcattcattttcatcataatgaattgattcagcactgcaaatgaaattaaattttattaatataaattttattatatatattaaaaattaaaaattaaaaaagtaatttaataataaaaaaggttatatcatatgatataataaaatataatatttttaatattatatttaaaaaatatttttgagattgtattacatgatataatataatagaaatctttaagattacataaaatattttttaagattgtattcaaatatagtatagaatattttttaatattgcatcaaaaataggatagaatatttttaagattgtattacataatataaaatatatttaaaattgtattgcataatatgataaaatatttttaggattgcattaaaaaattggttaaaatcgtatgcttaaattagtataaatagaaacatattttgtggtaatcaattcattacgatgataacgaattataagtattataactgattaccaggcaaggtttttaatttcacttgcaatgctgaatcaattcattatgatgaaaatgaatgacaactattataaataatttttagaataagcttttacttttacattgaagttgctgtataattcaagatgatgaaaaaatggtttgtgaaaataattgtgattgtggcagataatgaggggtgtttttgagccaacagtgacaccagacgctttggagaaacagcctcaactatgttgtgagatgtgccaaaagaaggggaagcatgttgatataaaacaatcaagggaaggacatgcaagtgttgctaaggtgtttgttgcctcctcttcttctcaaaaggatcttgcaaaggtgagatttgtgccgttaaaaaatggccccagttcaaattccaactgctggtggtattcttcaaatgtaatatcgggtgaaggatgcacacaactctgctgctcgatgattcgggccttacagggtaattatgtgtaggagagaatggtgttgaaatttaactatgagtgacggagctatattgttgcaagtaatgaccatgacacaatatataagataaaatttggagttatctaatgggaaattttttttaataattatatatacttatataattaattatgattaaaaataaaatttgacactactttaaaataaaatttaatattatttaaaatttgatactatctaaaatttgatatacatatataaatttgattatacttaaatttgatactaataataataaattggtgtcttccatcttgttgtaattggcttattgtttagaccatagcgcagctttgcatatgaaattaaggtttttttttttttttttactttgacaattttttcggattcatatgaaattaattttgaaccttcttgctgtcaatttatgaagggttgactttttctatgtgttgctttctgatcaagtagagcttcctattctttaattatttaaaatctaaaggctcaaatttatgtttggatggagactgaatctggaccactcattggtacctaagattctaaaacctcaatctatttctcatttttgtctcttctttactgactctgccacaattccataaacctcttgacttctctcagttttcaccaaacactagctcgctggtttatacgattttcgttcatcggagttattattctcaaaccagttcgattaacgctttccccttatcttccacgtcaatatccaatgctttgggcattagttgcaaatttgccatctttgtcgctgacacatttagttcatgattggcgatgtgtatgttcttggatgttttatattgtgtgtttaggtcttatttgatcaacgaggtttcattggattttgattgaggagattcttctattggtcaattgaattatcaaattggttccttacttttatcttggtgagttttggacttatttggattgatgaaaagaaatagaatgagataaagtggaatataatggaataaaatttccagtctattggttgcatatattataatagcatgaaacaaaatttacattctattatttaaaagaagaaaatgaataattattttattatcatattatcttaattttaagaaaaattgaaatattatatttaatctctaacaatctgctttacccatagatgaagaggagtttttttttttttttttgaaatatatggctcattatgattttaatatttgcattcaattaagaggtgactatgctcatcagctcatgtatacttcactcttaacatcaaacggaaagatagttcccttcccattcaattcttcattctctctatacatgcccaactgaaaatcctattttatgtatgtagaaaccccagaaagtcttgttctcacgaccccgtcatatgatcggatcctcctccaccttgttgtgcaggaaacggattgactctaatattatgaagcaactgctgtagtcatctcctagctgttgggtcttcctgaataaataaaaccaaaaccataaaaaaatgtaaacatcctaaaaccatgaataatctcttcataagaagaggagaaaaatctctagctcggaaatttgaagagagcaagctttacaagttaatgccctattgttaatcttcaattcacttaatcaactcacttcaatcttattgattaaatcaaatttttatactaataatatcacttacacgaaggcaactaaatgtagcataacttaacacggctggaggttcttaatgcatgacaagctctgttttgaaatgaccaaagttttattagaaacttgggaagaacggcatgggcagaactgcagaagcacttataaaactggagttactatctacttaacaaacctctgattttctgacagacgaagataacaacgaataatgaccttcaaaagacgacatgaaggttgctgaacaagagttaccaccatcgttccgaaaactatatatacttgaaaaaggcgccctgctgaagtacaaatatgtttcataccattttcaaccgacagaatttgttcaactataaaggttccaacctgcagttgggggaacttccattagattacacacaaattttcccattacaattattttgataggcataaaaagaggatcacgagatagtggcaaaaacaaacacgtggcttagcatttacaatgcaccaccaagtacaatgcaagagttaaacaaacgtgttatttaaagatttagatctcaagtatcaaggacggggtatttcaacccatgtaactacaaatactgtgtcgagttgcattttgatacaaccaagaggagtgtttgtatggaaaattataatagtgattcttacttctcgtttgatgagtctctgtcttaatttaaaagtggaacttaccaaagtttgtgattttcaacaaatttcaaccactaatagaatgttaaaaggagtattgctagcactcttctacaaccaaatatgtcaagaagagtttcaacagtcttgtgataaccactaaaaaaatcctactgagtgatgagcaacaaaggtcaaagaagcacctcttcattgagaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaccaaaaaaaaacaaattaggagcatgtttaattctctctttttataataaaaaattacactactcaacaatgaatgtatcatctaaaatctattaagttttgaagattgtttctgaaacaaacaaaaatgcatcaaagtacaaccaaattttcaagactatacataaaactctaggatttgaaacaaacaggtattctagaaacaaaatattagtcagtatttacggggctattcattaataaaaaatataaaagacaagaaagaataaaaaagcaaaagaaagccatgagttacaaaaggaatatgtaataataccagtaaaagtgctgcaacggtaccaaaagatttcgacaataatggagcaaataagtctcatctaaaatatataaaatattaaccgtgtgagccttgaaacgacgacgcatgtgatatagcatatggaataatggggcgttgtaaatggggtagtggaaggagcctgcgacacatgatatgatctgctttgcatgcaaactaaaacgaccgtttctatcaccgtgcgtgtccctcctaattctttcaactttatcattattaattatatggaaaatgtttattagccttctcttatgaaattaaaagtctaaagttttattgagaaatttaacaatatatttattcttactaaaatctgaaaattttaatacgatgaaggacgaattcaagttggttccaaactctgatggtccaagtgtgtagagtggttacagcaacaaataagttgttgttgataagagagacacgttgttaagtattaatttccagttccgtggacacatgtatatttactataacaaggtgatggatacgtgtacatttattataataggatgatggacatgtgtacaatgcacaataattttactaattttgtgcagtacaatatcctctcataattttcaatacaatttcaatgattaattgatcatacattccgtaccttgctaaaaaactttctattttttattctttatgaatttttgtaagtaacttaatttatattacttcaatcttatgtaattcaattaattttctctctaataatttttatattaataagttgtctaactcacaaatattttacttatatctcctatatttactataaagttaagtaactcgtgaataatagttacttatataaataactctctaatttaaattaattcaatatcacattagaaacactaaaataatatttaatttttttaagtaactctcatcatagatgctctcattattatatagattaaaatcaaatttttaaaaaagaaatggataattgttttattaatgaaataattatcaataataaatataataaaaaataaaaaatacatatgtttgaaatttttaattttgatgaatttaaacatgaatttaattaataaatattaatttttatataagtatacataaaatgtgaaaatgtaaattaaaaagtaaagaattgttgttttattaataataaatataaaataaattattaaatatatgtttaaaannnnnnnnnnattaattgaaaaaataaatattgatacggatagataaggaaattaaaaaaaatgaataaaaaaatgatataaaaaatatgttatgaaatgaaaaaggttaaaggggaaatatttagtgtaaacatttaagaataaaatatataaatttgagtcatataacgttaaataattaagattaaaaattaattaatagtcacatgatgattttaatttttaataaattatctttatttatcttttaacaatgatcatttagatattagctgataattacatttgttaggacaaatgataaaacaaatctttcaaatgttttattgatttatgtgaaggggtttagttcatttgattaaatagagtctttgagttatcgtaaatttttttatacttatcaattttcacgaataaaaagtatattttgaatgatcttatattaagagctaaattgactaaggaaatgagtcataatcattatggagaacatgcatggtccaacaatcttttatatttaataactatagatagtattgtcatgaacttagccgttttagaaccatccatgattggggatcggaactcatggatccatttgcaactccttagaaatattatctgaataatatttctttctcatacttcaaatgctttgtagagtgttcaataaggtgttcttttaatagtttccatacctataagattattaacgatatcctttttagataatgttaataaattccaaaattcattatgtccttcagtcaccactatagtaatgacgactatcttttctattggtaatgtagttgttctttggttaggtattgaaataacattacccattgagaaatccctgtatttttttaacttacaaaattgattcaattttaaaataaaaatagaatgtgatgtgtattgtatatttaaggagaattcttttaaaacaactaatttctaaatacatctatttcattttagatctattctaaacatatgaatttgttctaaatatttaaattacatattttcttattgtaagtttatcaaaagaaagaaataatttctttcaaaagatcatgtgatacacttgttacaaagactagaggtgacagatatagataatacacataaggtcataaccgtaactaggttcgactttaatatgatacacgcacaaaaacttattacgaagaaatgatataatttcttaaacaaggagatagcaaaacacatttttttaaattaattataatttcatgtaacatcttcatactgattttctagttttttttatgaaatattttttctatttttaaatatcaaataaatttattatttataaaatatttggaagactaattaaaagtatcatttcttataaaagagtgaaaaaattaataaaaataacagataaaaaacataaataaattaagaagtaattttaatataaataaaaagatattaataaggacatatattaagtggtctttatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatattcttaactcgtcttctttgttagatataataatgaaacaacctaaaaggaaaataaattactatcccacaagcacaagtgaatgtttacttcattttttcaattaaaaaattcaatcatattattattgtatcaaaaaaaaaaacacattattgaggcaatatattcgacgcatgctgtaatgctcatgcatagatactcacatacacacacatatattcaatgagagcaagatgtcatgtcccacctactcaatgagaacaagatgtagtgacccacctactcaatgagagtaagatgtcgtgaccggcctattgacctacctacccaaacacgcacttttaaaaggaatttgacttagttataaaaaaaaatctggaaggaccggacttggaatgaagtgagacagggtgagagtgaaaggggaggagatagggggtttaggatgggccacccccaaattttattaatataaattttattatatatattaaaaattaaaaattaaaaaagtaatttaataataaaaaagattatattacataatataataagatataatattttttaatattacattaaaaaataagataaaatatttttgaaattgtattacataatataataaaaatctttaaaattacattacataataagataaaatattttttaagattgtattcaaatatagtatataatattttttaatattgtatcaaaaataggataacatataaaatatttttaatatttaattgcataatataaaatatatttaagattgtattacttcgaagcttgcaatagaatccggaatgagccctcttgtccttgttgcttattgacaactcttcgctactgtgtccattgctccctttgcttattggctcgaatggtaattatatatatatatatatatatatatatgtgtataccctttctgattttgttttatttcatatatatacacagttcatgcatgaaagggtttgatcaactttgaaccacctatatcattctcatcacagtgagtgtcaccgttcgatatcccttttgttttgtttgattcaaaagaaaaatgctatatgttgttctgatgattaagtaacggactttccatttatattagacaaaaataatcataagaaaaacagtaacggatatacttagcattcttcttaaataaataaaaaaagaagaaagaagttgttgttctacatgaagttggactttatcatactcaaacgttttctaacggttaatgaaactggtgaaagaaaaacattcatgaatgaggctttttcttgcattgctgagaatctacaaacgaaaaacatgcatgaagaaactgagagaatatcacaaaattagcaacaagacaacaaccataatcaatagtgacacagttaatagggaattaaactgcttgattaaaagttactaaaacacatgttgcacgctttgtcttgttctcatgtgtagagtgtagtttagggtttagggtttaaacaatgaagacgctaacagcatgcgtgagtctttgggcatgttacgtgccagcacctttctattattaagacaaatagtgcaacacgttctcacggagtttcttataaaagggtagggtcatagagttgtagtagcgggtgacttatattgcagtttcattaatggcttgtctcgtacttctacgagaaataatctcggtggaaattgtcaggttcttgttgctgcaggcatattattaactttatttatgaatacacaacaaaggactagactctagagtgagtgaatagagacaagacaaagaataacaaa
